US008871214B2

United States Patent
Serino et al.

(10) Patent No.: US 8,871,214 B2
(45) Date of Patent: Oct. 28, 2014

(54) **DETOXIFIED *ESCHERICHIA COLI* IMMUNOGENS**

(75) Inventors: Laura Serino, Siena (IT); Danilo Gomes Moriel, Montariggioni (IT); Maria Rita Fontana, Siena (IT)

(73) Assignee: Novartis AG, Basel (CH)

( * ) Notice: Subject to any disclaimer, the term of this patent is extended or adjusted under 35 U.S.C. 154(b) by 10 days.

(21) Appl. No.: 13/384,224

(22) PCT Filed: Jul. 16, 2010

(86) PCT No.: PCT/IB2010/002043
§ 371 (c)(1),
(2), (4) Date: May 7, 2012

(87) PCT Pub. No.: WO2011/007257
PCT Pub. Date: Jan. 20, 2011

(65) Prior Publication Data
US 2012/0207777 A1 Aug. 16, 2012

Related U.S. Application Data

(60) Provisional application No. 61/290,654, filed on Dec. 29, 2009, provisional application No. 61/226,219, filed on Jul. 16, 2009.

(51) Int. Cl.
| | | |
|---|---|---|
| *A61K 39/02* | (2006.01) | |
| *C07K 1/00* | (2006.01) | |
| *C12N 1/20* | (2006.01) | |
| *C07H 21/04* | (2006.01) | |
| *C07K 14/245* | (2006.01) | |
| *A61K 39/00* | (2006.01) | |

(52) U.S. Cl.
CPC .............. *C07K 14/245* (2013.01); *A61K 39/00* (2013.01)
USPC ............. 424/190.1; 435/252.3; 530/350; 536/23.7

(58) Field of Classification Search
None
See application file for complete search history.

(56) References Cited

FOREIGN PATENT DOCUMENTS

WO WO-2006/089264 A2 8/2006
WO WO-2009/104092 A2 8/2009

OTHER PUBLICATIONS

Karata et al (Journal of Biological Chemistry, 274(37):26225-26232, 1999).*
Hooper et al. FEBS Letters, 354:1-6, 1994.*
International Search Report mailed Dec. 16, 2010, for PCT/IB2010/002043, 3 pages.
Moriel et al. (May 2010). "Identification of protective and broadly conserved vaccine antigens from the genome of extraintestinal pathogenic *Escherichia coli*," PNAS 107(20):9072-77.
Rao et al. (Sep. 1, 1998). "Molecular and biotechnological aspects of microbial proteases," Microbiol and Molec Biol Rev 62(3):597-635.

* cited by examiner

*Primary Examiner* — Patricia A Duffy
(74) *Attorney, Agent, or Firm* — Morrison & Foerster LLP

(57) ABSTRACT

Detoxified variants of the pathogenic *E. coli* 'AcfD precursor' (orf3526) have been identified that raise a substantially similar immune response in a subject as the native AcfD (orB526) protein. The detoxified variants may be further modified to have increased solubility as compared to the native AcfD (orf3526) protein.

15 Claims, 20 Drawing Sheets

FIG. 1A

```
                    10         20         30         40         50         60         70
                     |          |          |          |          |          |          |
SEQID3      MNKKFKYKKSLLAAILSATLLAGCDGGGSGSSSDTPPVDSGTGSLPEVKPDPTPNPEPTPEPTPDPEPTP
SEQID4      MNKKFKYKKSLLAAILSATLLAGCDGGGSGSSSDTPPVDSGTGSLPEVKPDPTPNPEPTPEPTPDPEPTP
SEQID12     MNKKFKYKKSLLAAILSATLLAGCDGGGSGSSSDTPPVDSGTGSLPEVKPDPTPNPEPTPEPTPDPEPTP
SEQID16     MNKKFKYKKSLLAAILSATLLAGCDGGGSGPSSDTPPVDSGTGSLPEVKPDPTPNPEPTPEPTPDPEPTP
SEQID5      MNKKFKYKKSLLAAILSATLLAGCDGGGSGSSSDTPPVDSGTGSLPEVKPDPTPNPEPTPEPTPDPEPTP
SEQID14     MNKKFKYKKSLLAAILSATLLAGCDGGGSGSSSDTPPVDSGTGSLPEVKPDPTPNPEPTPEPTPDPEPTP
SEQID6      MNKKFKYKKSLLAAILSATLLAGCDGGGSGSSSDTPPVDSGTGSLPEVKPDPTPNPEPTPEPTPDPEPTP
SEQID8      MNKKFKYKKSLLAAILSATLLAGCDGGGSGSSSDTPPVDSGTGSLPEVKPDPTPNPEPTPEPTPDPEPTP
SEQID9      MNKKFKYKKSLLAAILSATLLAGCDGGGSGSSSDTPPVDSGTGSLPEVKPDPTPNPEPTPEPTPDPEPTP
SEQID11     MNKKFKYKKSLLAAILSATLLAGCDGGGSGSSSDTPPVDSGTGSLPEVKPDPTPNPEPTPEPTPDPEPTP
SEQID7      MNKKFKYKKSLLAAILSATLLAGCDGGGSGSSSDTPPVDSGTGSLPEVKPDPTPNPEPTPEPTPDPEPTP
SEQID13     MNKKFKYKKSLLAAILSATLLAGCDGGGSGSSSDTPPVDSGTGSLPEVKPDPTPNPEPTPEPTPDPEPTP
SEQID15     MNKKFKYKKSLLAAILSATLLAGCDGGGSGSSSDTPPVDSGTGSLPEVKPDPTPNPEPTPEPTPDPEPTP
SEQID2      MNKKFKYKKSLLAAILSATLLAGCDGGGSGSSSDTPSVDSGSGTLPEVKPDPTPTPEPTPEPTPDPEPTP
SEQID10     MNKKFKYKKSLLAAILSATLLAGCDGGGSGSSSDTPSVDSGSGTLPEVKPDPTPTPEPTPEPTPDPEPTP
            ******************************* ***** ****.*.*************.**********

PRIM.CONS.  MNKKFKYKKSLLAAILSATLLAGCDGGGSGSSSDTPPVDSGTGSLPEVKPDPTPNPEPTPEPTPDPEPTP
N-TERM REG  GGGGGGGGGGGGGGGGGGGGGGGGGGGGGGGGPPPPPPPPPPPPPPPPPPPPPPPPPPPPPPPPPPPPPP 80         90        100        110        120        130        140
                     |          |          |          |          |          |          |
SEQID3      EPTPDP--EPTPEPEPEPVPTKTGYLTLGGSQRITG-ATCNGESSDGFTFTPGDKVTCVAGNNTTIATFD
SEQID4      EPTPDP--EPTPEPEPEPVPTKTGYLTLGGSQRITG-ATCNGESSDGFTFTPGDKVTCVAGNNTTIATFD
SEQID12     EPTPDP--EPTPEPEPEPVPTKTGYLTLGGSQRITG-ATCNGESSDGFTFTPGDKVTCVAGNNTTIATFD
SEQID16     DPTPDP--EPTPEPEPEPVPTKTGYLTLGGSQRITG-ATCNGESSDGFTFTPGDKVTCVAGNNTTIATFD
SEQID5      EPIPDP--EPTPEPEPEPVPTKTGYLTLGGSQRVTG-ATCNGESSDGFTFKPGEDVTCVAG-NTTIATFN
SEQID14     EPIPDP--EPTPEPEPEPVPTKTGYLTLGGSQRVTG-ATCNGESSDGFTFKPGEDVTCVAG-NTTIATFN
SEQID6      EPTPDP--EPTPEPEPEPVPTKTGYLTLGGSLRVTGDITCNDESSDGFTFTPGDKVTCVAGNNTTIATFD
SEQID8      EPTPDP--EPTPEPEPEPVPTKTGYLTLGGSLRVTGDITCNDESSDGFTFTPGDKVTCVAGNNTTIATFD
SEQID9      EPTPDP--EPTPEPEPEPVPTKTGYLTLGGSLRVTGDITCNDESSDGFTFKPGEDVTCVAG-NTTIATFN
SEQID11     EPIPDP--EPTPEPEPEPVPTKTGYLTLGGSLRVTGDITCNDESSDGFTFTPGDKVTCVAGNNTTIATFD
SEQID7      EPTPDP--EPTPEPEPEPVPTKTGYLTLGGSQRVTG-ATCNGESSDGFTFKPGEDVTCVAG-NTTIATFN
SEQID13     EPIPDP--EPTPEPEPEPVPTKTGYLTLGGSQRVTG-ATCNGESSDGFTFKPGEDVTCVAG-NTTIATFN
SEQID15     EPIPDP--EPTPEPEPEPVPTKTGYLTLGGSQRVTG-ATCNGESSDGFTFKPGEDVTCVAG-NTTIATFN
SEQID2      DPTPDP--EPTPEPEPEPVPTKTGYLTLGGSQRVTG-ATCNGESSDGFTFTPGNTVSCVVG-STTIATFN
SEQID10     DPTPDPDPEPTPEPEPEPVPTKTGYLTLGGSQRVTG-ATCNGESSDGFTFTPGNTVSCVVG-STTIATFN
            :*.***  **********************:** ***.********.**: *:**.* .*****:

PRIM.CONS.  EPTPDPDPEPTPEPEPEPVPTKTGYLTLGGSQRVTGDATCNGESSDGFTFTPGDKVTCVAGNNTTIATFD
N-TERM REG  PPPPPPPPPPPPPPPPPPPPPPPPP
```

FIG. 1B

```
              150       160       170       180       190       200       210
               |         |         |         |         |         |         |
SEQID3      TQSEAARSLRAVEKVSFSLEDAQELAASDDKKSNAVSLVTSSNSCPANTEQVCLTFSSVIESKRFDSLYK
SEQID4      TQSEAARSLRAVEKVSFSLEDAQELAASDDKKSNAVSLVTSSNSCPADTEQVCLTFSSVIESKRFDSLYK
SEQID12     TQSEAARSLRAVEKVSFSLEDAQELAASDDKKSNAVSLVTSSNSCPANTEQVCLTFSSVIESKRFDSLYK
SEQID16     TQSEAARSLRAVEKVSFSLEDAQELAASDDKKSNAVSLVTSSNSCPADTEQVCLTFSSVIESKRFDSLYK
SEQID5      TQSEAARSLRAVEKVSFSLEDAQELAGSDDKKSNAVSLVTSSNSCPANTEQVCLTFSSVIESKRFDSLYK
SEQID14     TQSEAARSLRAVEKVSFSLEDAQELAGSDDKKSNAVSLVTSSNSCPANTEQVCLTFSSVIESKRFDSLYK
SEQID6      TQSEAARSLRAVEKVSFSLEDAQELAGSDNKKSNALSLVTSMNSCPANTEQVCLEFSSVIESKRFDSLYK
SEQID8      TQSEAARSLRAVEKVSFSLEDAQELAGSDNKKSNALSLVTSMNSCPANTEQVCLEFSSVIESKRFDSLYK
SEQID9      TQSEAARSLRAVEKVSFSLEDAQELAGSDNKKSNALSLVTSMNSCPANTEQVCLEFSSVIESKRFDSLYK
SEQID11     TQSEAARSLRAVEKVSFSLEDAQELAGSDDKKSNAVSLVTSSNSCPANTEQVCLTFSSVIESKRFDSLYK
SEQID7      TQSEAARSLRAVEKVSFSLEDAQELAGSDNKKSNALSLVTSMNSCPANTEQVCLEFSSVIESKRFDSLYK
SEQID13     TQSEAARSLRAVEKVSFSLEDAQELAGSDDKKSNAVSLVTSSNSCPANTEQVCLTFSSVIESKRFDSLYK
SEQID15     TQSEAARSLRAVEKVSFSLEDAQELAGSDDKKSNAVSLVTSSNSCPANTEQVCLTFSSVIESKRFDSLYK
SEQID2      TQSEAARSLRAVDKVSFSLEDAQELANSENKKTNAISLVTSSDSCPADAEQLCLTFSSVVDRARFEKLYK
SEQID10     TQSEAARSLRAVDKVSFSLEDAQELANSENKKTNAISLVTSSDSCPADAEQLCLTFSSVVDRARFEKLYK
            ************:************ *::**:**:***** ;****;:**:** ****;:  **:.***
PRIM.CONS.  TQSEAARSLRAVEKVSFSLEDAQELAGSDDKKSNAVSLVTSSNSCPANTEQVCLTFSSVIESKRFDSLYK 220       230       240       250       260       270       280
               |         |         |         |         |         |         |
SEQID3      QIDLAPEEFKKLVNEEVENNAATDKAPSTHTSPVVPVTTPGTKPDLNASFVSANAEQFYQYQPTEIILSE
SEQID4      QIDLAPEEFKKLVNEEVENNAATDKAPSTHTSPVVPVTTPGTKPDLNASFVSANAEQFYQYQPTEIILSE
SEQID12     QIDLAPEEFKKLVNEEVENNAATDKAPSTHTSPVVPVTTPGTKPDLNASFVSANAEQFYQYQPTEIILSE
SEQID16     QIDLAPEEFKKLVNEEVENNAATDKAPSTHTSPVVPVTTPGTKPDLNASFVSANAEQFYQYQPTEIILSE
SEQID5      QIDLAPEEFKKLVNEEVENNAATDKAPSTHTSPVVPVTTPGTKPDLNASFVSANAEQFYQYQPTEIILSE
SEQID14     QIDLAPEEFKKLVNEEVENNAATDKAPSTHTSPVVPVTTPGTKPDLNASFVSANAEQFYQYQPTEIILSE
SEQID6      QIDLAPEEFKKLVNEEVENNAATDKAPSTHTSPVVPVTTPGTKPDLNASFVSANAEQFYQYQPSEIILSE
SEQID8      QIDLAPEEFKKLVNEEVENNAATDKAPSTHTSPVVPVTTPGTKPDLNASFVSANAEQFYQYQPSEIILSE
SEQID9      QIDLAPEEFKKLVNEEVENNAATDKAPSTHTSPVVPATTPGTKPDLNASFVSANAEQFYQYQPTEIILSE
SEQID11     QIDLAPEEFKKLVNEEVENNAATDKAPSTHTSPVVPVTTPGTKPDLNASFVSANAEQFYQYQPSEIILSE
SEQID7      QIDLAPEEFKKLVNEEVENNAATDKAPSTHTSPVVPVTTPGTKPDLNASFVSANAEQFYQYQPSEIILSE
SEQID13     QIDLAPEEFKKLVNEEVENNAATDKAPSTHTSPVVPVTTPGTKPDLNASFVSANAEQFYQYQPTEIILSE
SEQID15     QIDLAPEEFKKLVNEEVENNAATDKAPSTHTSPVVPVTTPGTKPDLNASFVSANAEQFYQYQPTEIILSE
SEQID2      QIDLATDNFSKLVNEEVENNAATDKAPSTHTSTVVPVTTEGTKPDLNASFVSANAEQFYQYQPTEIILSE
SEQID10     QIDLATDNFSKLVNEEVENNAATDKAPSTHTSTVVPVTTEGTKPDLNASFVSANAEQFYQYQPTEIILSE
            *****.::*.*********************.***.** ************************:******
PRIM.CONS.  QIDLAPEEFKKLVNEEVENNAATDKAPSTHTSPVVPVTTPGTKPDLNASFVSANAEQFYQYQPTEIILSE
```

FIG. 1C

```
              290       300       310       320       330       340       350
                |         |         |         |         |         |         |
SEQID3     GRLVDSMGNGVVGVNYYTSSGRGVTGENGKFNFSWGETISFGIDTFELGSVRGNKSTIALTELGDEVRGA
SEQID4     GRLVDSMGNGVVGVNYYTSSGRGVTGENGKFNFSWGETISFGIDTFELGSVRGNKSTIALTELGDEVRGA
SEQID12    GRLVDSMGNGVVGVNYYTSSGRGVTGENGKFNFSWGETISFGIDTFELGSVRGNKSTIALTELGDEVRGA
SEQID16    GRLVDSQGYGVAGVNYYTNSGRGVTGENGEFSFSWGETISFGIDTFELGSVRGNKSTIALTELGDEVRGA
SEQID5     GRLVDSQGYGVAGVNYYTNSGRGVTGENGEFSFSWGETISFGIDTFELGSVRGNKSTIALTELGDEVRGA
SEQID14    GRLVDSQGYGVAGVNYYTNSGRGVTGENGEFSFSWGETISFGIDTFELGSVRGNKSTIALTELGDEVRGA
SEQID6     GRLVDSQGYGVAGVNYYTNSGRGVTGENGEFSFSWGETISFGIDTFELGSVRGNKSTIALTELGDEVRGA
SEQID8     GRLVDSQGYGVAGVNYYTNSGRGVTGENGEFSFSWGETISFGIDTFELGSVRGNKSTIALTELGDEVRGA
SEQID9     GRLVDSQGDGVVGVNYYTNSGRGVTGENGEFSFSWGETISFGIDTFELGSVRGNKSTIALTELGDEVRGA
SEQID11    GRLVDSQGYGVAGVNYYTNSGRGVTGENGEFSFSWGEAISFGIDTFELGSVRGNKSTIALTELGDEVRGA
SEQID7     GRLVDSQGYGVAGVNYYTNSGRGVTGENGEFSFSWGETISFGIDTFELGSVRGNKSTIALTELGDEVRGA
SEQID13    GRLVDSQGYGVAGVNYYTNSGRGVTGENGEFSFSWGETISFGIDTFELGSVRGNKSTIALTELGDEVRGA
SEQID15    GRLVDSQGYGVAGVNYYTNSGRGVTGENGEFSFSWGETISFGIDTFELGSVRGNKSTIALTELGDEVRGA
SEQID2     GQLVDSLGNGVAGVDYYTNSGRGVTDENGKFSFSWGETISFGIDTFELGSVRGNKSTIALTELGDEVRGA
SEQID10    GQLVDSLGNGVAGVDYYTNSGRGVTDENGKFSFSWGETISFGIDTFELGSVRGNKSTIALTELGDEVRGA
           *:**** * **.**:*** .*****.***:*.*****:************************

PRIM.CONS. GRLVDSQGYGVAGVNYYTNSGRGVTGENGEFSFSWGETISFGIDTFELGSVRGNKSTIALTELGDEVRGA 360       370       380       390       400       410       420
                |         |         |         |         |         |         |
SEQID3     NIDQLIHRYSQAGKNDEREVPDVVRKVFAEYPNVINEIINLSLSNGEALSEGDQTFERTNEFLEQFESGQ
SEQID4     NIDQLIHRYSQAGKNDEREVPDVVRKVFAEYPNVINEIINLSLSNGEALSEGDQTFERTNEFLEQFESGQ
SEQID12    NIDQLIHRYSQAGKNDEREVPDVVRKVFAAYPNVINEIINLSLSNGEALSEGDQTFERTNEFLEQFESGQ
SEQID16    NIDQLIHRYSTTGQNNTRVVPDDVRKVFAEYPNVINEIINLSLSNGATLDEGDQNVVLPNEFIEQFKTGQ
SEQID5     NIDQLIHRYSTTGQNNTRVVPDDVRKVFAEYPNVINEIINLSLSNGATLGEGEQVVNLPNEFIEQFNTGQ
SEQID14    NIDQLIHRYSTTGQNNTRVVPDDVRKVFAEYPNVINEIINLSLSNGATLGEGEQVVNLPNEFIEQFNTGQ
SEQID6     NIDQLIHRYSTTGQNNTRVVPDDVRKVFAEYPNVINEIINLSLSNGATLDEGEQVVNLPNEFIEQFKTGQ
SEQID8     NIDQLIHRYSTTGQNNTRVVPDDVRKVFAEYPNVINEIINLSLSNGATLDEGEQVVNLPNEFIEQFKTGQ
SEQID9     NIDQLIHRYSKAGQNHTRVVPDEVRKVFAEYPNVINEIINLSLSNGATLGEGEQVVNLPNEFIEQFKTGQ
SEQID11    NIDQLIHRYSTTGQNNTRVVPDDVRKVFAEYPNVINEIINLSLSNGATLGEGEQVVNLPNEFIEQFNTGQ
SEQID7     NIDQLIHRYSTTGQNNTRVVPDDVRKVFAEYPNVINEIINLSLSNGATLGEGEQVVNLPNEFIEQFKTGQ
SEQID13    NIDQLIHRYSTTGQNNTRVVPDDVRKVFAEYPNVINEIINLSLSNGATLGEGEQVVNLPNEFIEQFNTGQ
SEQID15    NIDQLIHRYSTTGQNNTRVVPEDVRKVFAEYPNVINEIINLSLSNGATLGEGEQVVNLPNEFIEQFNTGQ
SEQID2     NIDQLIHRYSTTGQNNTRVVPDDVRKVFAEYPNVINEIINLSLSNGATLDEGDQNVVLPNEFIEQFKTGQ
SEQID10    NIDQLIHRYSTTGQNNTRVVPDDVRKVFAEYPNVINEIINLSLSNGATLDEGDQNVVLPNEFIEQFKTGQ
           **********.:*:*.* **:.***** ****************:*.**:*.   .***:***::**

PRIM.CONS. NIDQLIHRYSTTGQNNTRVVPDDVRKVFAEYPNVINEIINLSLSNGATLGEGEQVVNLPNEFIEQFKTGQ
```

FIG. 1D

```
              430       440       450       460       470       480       490
                |         |         |         |         |         |         |
SEQID3     AKEIDTAICDSLGGCNSQRWFSLTARNVNEGQIQGVINKLWGVDKDYKSVTKFHVFHDSTNFYGSTGNAR
SEQID4     AKEIDTAICDSLGGCNSQRWFSLTARNVNDGQIQGVINKLWGVDTNYKSVSKFHVFHDSTNFYGSTGNAR
SEQID12    AKEIDTAICDSLGGCNSQRWFSLTARNVNEGQIQGVINKLWGVDKDYKSVTKFHVFHDSTNFYGSTGNAR
SEQID16    AKEIDTAICAKTDGCNEARWFSLTTRNVNDGQIQGVINKLWGVDKDYKSVTKFHVFHDSTNFYGSTGNAR
SEQID5     AKEIDTAICAKTDGCNEARWFSLTTRNVNDGQIQGVINKLWGVDTNYKSVSKFHVFHDSTNFYGSTGNAR
SEQID14    AKEIDTAICAKTDGCNEARWFSLTTRNVNDGQIQGVINKLWGVDTNYKSVSKFHVFHDSTNFYGSTGNAR
SEQID6     AKEIDTAICAKTDGCNEARWFSLTTRNVNDGQIQGVINKLWGVDTNYKSVSKFHVFHDSTNFYGSTGNAR
SEQID8     AKEIDTAICAKTDGCNEARWFSLTTRNVNDGQIQGVINKLWGVDTNYKSVSKFHVFHDSTNFYGSTGNAR
SEQID9     AKEIDTAICAKTDGCNEARWFSLTTRNVNDGKIQGVINKLWGVDTNYKSVSKFHVFHDSTNFYGSTGNAR
SEQID11    AKEIDTAICAKTDGCNEARWFSLTTRNVNDGQIQGVINKLWGVDTNYKSVSKFHVFHDSTNFYGSTGNAR
SEQID7     AKEIDTAICAKTDGCNEARWFSLTTRNVNDGQIQGVINKLWGVDTNYKSVSKFHVFHDSTNFYGSTGNAR
SEQID13    AKEIDTAICAKTDGCNEARWFSLTTRNVNDGQIQGVINKLWGVDTNYKSVSKFHVFHDSTNFYGSTGNAR
SEQID15    AKEIDTAICAKTDGCNEARWFSLTTRNVNDGQIQGVINKLWGVDTNYKSVSKFHVFHDSTNFYGSTGNAR
SEQID2     AKEIDTAICAKTDGCNEARWFSLTTRNVNDGQIQGVINKLWGVDTNYQSVSKFHVFHDSTNFYGSTGNAR
SEQID10    AKEIDTAICAKTNGCNEARWFSLTTRNVNDGQIQGVINKLWGVDTNYQSVSKFHVFHDSTNFYGSTGNAR
           ********  ***  ****** **** * ************  * ** ********************
PRIM.CONS. AKEIDTAICAKTDGCNEARWFSLTTRNVNDGQIQGVINKLWGVDTNYKSVSKFHVFHDSTNFYGSTGNAR 500       510       520       530       540       550       560
                |         |         |         |         |         |         |
SEQID3     GQAVVNISNAAFPILMARNDKNYWLAFGEKRAWDKNELAYITEAPSLVEPENVTRDTATFNLPFISLGQV
SEQID4     GQAVVNISNAAFPILMARNDKNYWLAFGEKRAWDKNELAYITEAPSLVEPENVTRDTATFNLPFISLGQV
SEQID12    GQAVVNISNAAFPILMARNDKNYWLAFGEKRAWDKNELAYITEAPSLVEPENVTRDTATFNLPFISLGQV
SEQID16    GQAVVNISNAAFPILMARNDKNYWLAFGEKRAWDKNELAYITEAPSIVQPENVTRDTATFNLPFISLGQV
SEQID5     GQAVVNISNAAFPILMARNDKNYWLAFGEKRAWDKNELAYITEAPSLVEPENVTRDTATFNLPFISLGQV
SEQID14    GQAVVNISNAAFPILMARNDKNYWLAFGEKRAWDKNELAYITEAPSLVEPENVTRDTATFNLPFISLGQV
SEQID6     GQAVVNISNAAFPILMARNDKNYWLAFGEKRAWDKNELAYITEAPSLVEPENVTRDTATFNLPFISLGQV
SEQID8     GQAVVNISNAAFPILMARNDKNYWLAFGEKRAWDKNELAYITEAPSLVEPENVTRDTATFNLPFISLGQV
SEQID9     GQAVVNISNAAFPILMARNDKNYWLAFGEKRAWDKNELAYITEAPSIVRPENVTRETATFNLPFISLGQV
SEQID11    GQAVVNISNAAFPILMARNDKNYWLAFGEKRAWDKNELAYITEAPSIVRPENVTRETASFNLPFISLGQV
SEQID7     GQAVVNISNAAFPILMARNDKNYWLAFGEKRAWDKNDLAYITEAPSIVRPENVTRETATFNLPFISLGQV
SEQID13    GQAVVNISNAAFPILMARNDKNYWLAFGEKRAWDKNELAYITEAPSIVRPENVTRETATFNLPFISLGQV
SEQID15    GQAVVNISNAAFPILMARNDKNYWLAFGEKRAWDKNELAYITEAPSIVRPENVTRETATFNLPFISLGQV
SEQID2     GQAVVNISNSAFPILMARNDKNYWLAFGEKRAWDKNELAYITEAPSIVQPENVTRDTATFNLPFISLGQV
SEQID10    GQAVVNISNAAFPILMARNDKNYWLAFGEKRAWDKNELAYITEAPSIVQPENVTRDTATFNLPFISLGQV
           ********* ****************************  ******** * ***** ** **********
PRIM.CONS. GQAVVNISNAAFPILMARNDKNYWLAFGEKRAWDKNELAYITEAPSIVEPENVTRDTATFNLPFISLGQV
```

FIG. 1E

```
              570       580       590       600       610       620       630
               |         |         |         |         |         |         |
SEQID3    GEGKLMVIGNPHYNSILRCPNGYSWEGGVDKNGQCTRNSDSNDMKHFMQNVLRYLSDDKWTPDAKASMTV
SEQID4    GEGKLMVIGNPHYNSILRCPNGYSWEGGVDKNGQCTRNSDSNDMKHFMQNVLRYLSDDKWTPDAKASMTV
SEQID12   GEGKLMVIGNPHYNSILRCPNGYSWEGGVDKNGQCTRNSDSNDMKHFMQNVLRYLSNDKWTPDAKASMTV
SEQID16   GEGKLMVIGNPHYNSILRCPNGYSWNGGVNKDGQCTLSGDSDDMKHFMQNVLRYLSDDKWTPDAKASMTV
SEQID5    GEGKLMVIGNPHYNSILRCPNGYSWNGGVNKDGQCTLNSDPDDMKNFMENVLRYLSDDKWKPDAKASMTV
SEQID14   GEGKLMVIGNPHYNSILRCPNGYSWNGGVNKDGQCTLNSDPDDMKNFMENVLRYLSDDKWKPDAKASMTV
SEQID6    GEGKLMVIGNPHYNSILRCPNGYSWNGGVNKDGQCTLNSDPDDMKNFMENVLRYLSDDKWTPDAKASMTV
SEQID8    GEGKLMVIGNPHYNSILRCPNGYSWNGGVNKDGQCTLNSDPDDMKNFMENVLRYLSDDKWTPDAKASMTV
SEQID9    GDGKLMVIGNPHYNSILRCPNGYSWNGGVNKDGQCTLNSDPDDMKNFMENVLRYLSDDKWTPDAKASMTV
SEQID11   GDGKLMVIGNPHYNSILRCPNGYSWNGGVNKDGQCTLNSDPDDMKNFMENVLRYLSNDRWLPDAKSSMTV
SEQID7    GDGKLMVIGNPHYNSILRCPNGYSWNGGVNKDGQCTLNSDPDDMKNFMENVLRYLSNDRWLPDAKSSMTV
SEQID13   GDGKLMVIGNPHYNSILRCPNGYSWNGGVNKDGQCTLNSDPDDMKNFMENVLRYLSNDRWLPDAKSNMTV
SEQID15   GDGKLMVIGNPHYNSILRCPNGYSWNGGVNKDGQCTLNSDPDDMKNFMENVLRYLSNDRWLPDAKSNMTV
SEQID2    GEGKLMVIGNPHYNSILRCPNGYSWGGGVNSKGECTLSGDSDDMKHFMQNVLRYLSNDIWQPNTKSIMTV
SEQID10   GDGKLMVIGNPHYNSILRCPNGYSWGGGVNSKGECTLSGDSDDMKHFMQNVLRYLSNDIWQPNTKSIMTV
          *:**********************  ***:. .*.** .. .*. :***:**.*******:* * *:.:*. ***
PRIM.CONS. GEGKLMVIGNPHYNSILRCPNGYSWNGGVNKDGQCTLNSDPDDMKNFMENVLRYLSDDKWTPDAKASMTV 640       650       660       670       680       690       700
               |         |         |         |         |         |         |
SEQID3    GTNLDTVYFKRHGQVTGNSAEFGFHPDFAGISVEHLSSYGDLDPQEMPLLILNGFEYVTQVGNDPYAIPL
SEQID4    GTNLDTVYFKRHGQVTGNSAEFGFHPDFAGISVEHLSSYGDLDPQEMPLLILNGFEYVTQVGNDPYAIPL
SEQID12   GTNLDTVYFKRHGQVTGNSAEFGFHPDFAGISVEHLSSYGDLDPQKMPLLILNGFEYVTQVGGDPYAVPL
SEQID16   GTNLDTVYFKRHGQVTGNSAEFGFHPDFAGISVEHLSSYGDLDPQEMPLLILNGFEYVTQVGNDPYAIPL
SEQID5    GTNLDTVYFKRHGQVTGNSAAFDFHPDFAGISVEHLSSYGDLDPQEMPLLILNGFEYVTQVGNDPYAIPL
SEQID14   GTNLDTVYFKRHGQVTGNSAAFDFHPDFAGISVEHLSSYGDLDPQEMPLLILNGFEYVTQVGNDPYAIPL
SEQID6    GTNLDTVYFKRHGQVTGNSAAFDFHPDFAGISVEHLSSYGDLDPQEMPLLILNGFEYVTQVGNDPYAIPL
SEQID8    GTNLDTVYFKRHGQVTGNSAAFDFHPDFAGISVEHLSSYGDLDPQEMPLLILNGFEYVTQVGNDPYAIPL
SEQID9    GTNLDTVYFKRHGQVTGNSAAFDFHPDFAGISVEHLSSYGDLDPQEMPLLILNGFEYVTQVGNDPYAIPL
SEQID11   GTNLETVYFKKHGQVLGNSAPFAFHKDFTGITVKPMTSYGNLNPDEVPLLILNGFEYVTQWGSDPYSIPL
SEQID7    GTNLETVYFKKHGQVLGNSAPFAFHKDFTGITVKPMTSYGNLNPDEVPLLILNGFEYVTQWGSDPYSIPL
SEQID13   GTNLDTVYFKRHGQVTGNSAAFGFHPDFAGISVEHLSSYGDLDPQEMPLLILNGFEYVTQVGNDPYAIPL
SEQID15   GTNLDTVYFKRHGQVTGNSAAFGFHPDFAGISVEHLSSYGDLDPQEMPLLILNGFEYVTQVGNDPYAIPL
SEQID2    GTNLENVYFKKAGQVLGNSAPFAFHEDFTGITVRQLTSYGDLNPEEIPLLILNGFEYVTQWSGDPYAVPL
SEQID10   GTNLENVYFKKAGQVLGNSAPFAFHEDFTGITVRQLTSYGDLNPEEIPLLILNGFEYVTQWSGDPYAVPL
          ****:.****: *** ****:* ** **:.**:*: .:.:***:*:. :.:************* .***.:**
PRIM.CONS. GTNLDTVYFKRHGQVTGNSAAFGFHPDFAGISVEHLSSYGDLDPQEMPLLILNGFEYVTQVGNDPYAIPL
```

FIG. 1F

```
               710       720       730       740       750       760       770
                |         |         |         |         |         |         |
SEQID3     RADTSKPKLTQQDVTDLIAYLNKGGSVLIMENVMSNLKEESASGFVRLLDAAGLSMALNKSVVNNDPQGY
SEQID4     RADTSKPKLTQQDVTDLIAYLNKGGSVLIMENVMSNLKEESASGFVRLLDAAGLSMALNKSVVNNDPQGY
SEQID12    RADTSKPKLSQQDVTDLIAYLNKGGSVLIMENVMSNLKEESASGFVRLLDAAGLSMALNKSVVNNDPQGY
SEQID16    RADTSKPKLTQQDVTDLIAYLNKGGSVLIMENVMSNLKEESASGFVRLLDAAGLSMALNKSVVNTDPQGY
SEQID5     RADTSKPKLTQQDVTDLIAYLNKGGSVLIMENVMSNLKEESASGFVRLLDAAGLSMALNKSVVNNDPQGY
SEQID14    RADTSKPKLTQQDVTDLIAYLNKGGSVLIMENVMSNLKEESASGFVRLLDAAGLSMALNKSVVNNDPQGY
SEQID6     RADTSKPKLTQQDVTDLIAYLNKGGSVLIMENVMSNLKEESASGFVRLLDAAGLSMALNKSVVNNDPQGY
SEQID8     RADTSKPKLTQQDVTDLIAYLNKGGSVLIMENVMSNLKEESASGFVRLLDAAGLSMALNKSVVNNDPQGY
SEQID9     RADTSKPKLTQQDVTDLIAYLNKGGSVLIMENVMSNLKEESASGFVRLLDAAGLSMALNKSVVNNDPQGY
SEQID11    RADTSKPKLTQQDVTDLIAYMNKGGSVLIMENVMSNLKEESASGFVRLLDAAGLSMALNKSVVNNDPQGY
SEQID7     RADTSKPKLTQQDVTDLIAYMNKGGSVLIMENVMSNLKEESASGFVRLLDAAGLSMALNKSVVNNDPQGY
SEQID13    RADTSKPKLTQQDVTDLIAYMNKGGSVLIMENVMSNLKEESASGFVRLLDAAGLSMALNKSVVNNDPQGY
SEQID15    RADTSKPKLTQQDVTDLIAYMNKGGSVLIMENVMSNLKEESASGFVRLLDAAGLSMALNKSVVNNDPQGY
SEQID2     RADTSKPKLTQQDVTDLIAYLNKGGSVLIMENVMSNLKEESASSFVRLLDAAGLSMALNKSVVNNDPQGY
SEQID10    RADTSKPKLTQQDVTDLIAYLNKGGSVLIMENVMSNLKEESASGFVRLLDAAGLSMALNKSVVNNDPQGY
           ********:***********:*******************.*******************.*****

PRIM.CONS. RADTSKPKLTQQDVTDLIAYLNKGGSVLIMENVMSNLKEESASGFVRLLDAAGLSMALNKSVVNNDPQGY 780       790       800       810       820       830       840
                |         |         |         |         |         |         |
SEQID3     PNRVRQQRATGIWVYERYPAVDGALP-YTIDSKTGEVKWKYQVENKPDDKPKLEVASWLEDVDGKQETRY
SEQID4     PNRVRQQRATGIWVYERYPAVDGALP-YTIDSKTGEVKWKYQVENKPDDKPKLEVASWLEDVDGKQETRY
SEQID12    PDRVRQRRATGIWVYERYPVVEGELP-YTIDSKTGKVTWKYQIDNKPDKKPKLEVASWQEEVDGKQVTQF
SEQID16    PNRVRQQREKGIWVYERYPAVDSAQPPYTIDPDTGKVTWKYQEEGKPDDKPKLEVASWQEDVDGKQVTRY
SEQID5     PNRVRQQRATGIWVYERYPAVDGALP-YTIDSKTGEVKWKYQVENKPDDKPKLEVASWLEDVDGKQETRY
SEQID14    PNRVRQQRATGIWVYERYPAVDGALP-YTIDSKTGEVKWKYQVENKPDDKPKLEVASWLEDVDGKQETRY
SEQID6     PNRVRQQRATGIWVYERYPAVDGALP-YTIDSKTGEVKWKYQVENKPDDKPKLEVASWLEDVDGKQETRY
SEQID8     PNRVRQQRATGIWVYERYPAVDGALP-YTIDSKTGEVKWKYQVENKPDDKPKLEVASWLEDVDGKQETRY
SEQID9     PNRVRQRRSTPIWVYERYPAVDGKPP-YTIDDTTKEVIWKYQQENKPDDKPKLEVASWQEEVEGKQVTQF
SEQID11    PNRVRQRRSTPIWVYERYPAVDGKPP-YTIDDTTKEVIWKYQQENKPDDKPKLEVASWQEEVEGKQVTQF
SEQID7     PDRVRQRRSTPIWVYERYPAVDGKPP-YTIDDTTKEVIWKYQQENKPDDKPKLEVASWQEEVEGKQVTQF
SEQID13    PDRVRQRRSTPIWVYERYPAVDGKPP-YTIDDTTKEVIWKYQQENKPDDKPKLEVASWQEEVEGKQVTQF
SEQID15    PDRVRQRRSTPIWVYERYPAVDGKPP-YTIDDTTKEVIWKYQQENKPDDKPKLEVASWQEEVEGKQVTQF
SEQID2     PDRVRQRRATGIWVYERYPAADGAQPPYTIDPNTGEVTWKYQQDNKPDDKPKLEVASWQEEVEGKQVTRY
SEQID10    PDRVRQQREKGIWVYERYPFVDG-KPPYTIDETTKEVIWKYQQDNKPDDKPKLEVASWLEDVDGKQVKRY
           *:****:* ,********  :,  * ****  *:*  ****::***,*********  *:*:***  ,::

PRIM.CONS. PNRVRQQRATGIWVYERYPAVDGALPPYTIDSKTGEV2WKYQQENKPDDKPKLEVASWQEDVDGKQVTRY
```

FIG. 1G

```
                     850        860        870        880        890        900        910
                      |          |          |          |          |          |          |
SEQID3      AFIDEADHKTEDSLKAAKAKIFEKFPGLKECKDPTYHYEVNCLEYRPGTGVPVTGGMYVPQYTQLSLNAD
SEQID4      AFIDEADHKTEDSLKAAKAKIFEKFPGLKECKDPTYHYEVNCLEYRPGTGVPVTGGMYVPQYTQLSLNAD
SEQID12     AFIDEADHKTTESLDAAKKRILEKFKGLEECKDSTYHYEINCLEYRPGTNVPATGGMYVPRYTQLNLSAD
SEQID16     AFIDEAEHSTEESLEAAKAKIFEKFPGLQECKDSTYHYEINCLERRPGTDVPVTGGMYVPRYTQLNLDAD
SEQID5      AFIDEADHKTEDSLKAAKEKIFAAFPGLKECTNPAYHYEVNCLEYRPGTGVPVTGGMYVPQYTQLSLNAD
SEQID14     AFIDEADHKTEDSLKAAKEKIFAAFPGLKECTNPAYHYEVNCLEYRPGTGVPVTGGMYVPQYTQLSLNAD
SEQID6      AFIDEADHKTEDSLKAAKEKIFAAFPGLKECTNPAYHYEVNCLEYRPGTGVPVTGGMYVPQYTQLSLNAD
SEQID8      AFIDEADHKTEDSLKAAKEKIFAAFPGLKECTNPAYHYEVNCLEYRPGTGVPVTGGMYVPQYTQLSLNAD
SEQID9      AFIDEADHKTPESLAAAKQRILDAFPGLEVCKDSDYHYEVNCLEYRPGTDVPVTGGMYVPQYTQLDLSAD
SEQID11     AFIDEADHKTPESLAAAKQRILDAFPGLEVCKDSDYHYEVNCLEYRPGTDVPVTGGMYVPQYTQLDLSAD
SEQID7      AFIDEADHKTPESLAAAKQRILDAFPGLEVCKDSDYHYEVNCLEYRPGSGVPVTGGMYVPQYTQLDLGAD
SEQID13     AFIDEADHKTPESLAAAKKRILDAFPGLEECKDSDYHYEVNCLEYRPGTGVPVTGGMYVPQYTQLSLNAD
SEQID15     AFIDEADHKTPESLAAAKKRILDAFPGLEECKDSDYHYEVNCLEYRPGTGVPVTGGMYVPQYTQLSLNAD
SEQID2      AFIDEAEYTTEESLEAAKAKIFEKFPGLQECKDSTYHYEINCLERRPGTDVPVTGGMYVPRYTQLNLDAD
SEQID10     AFIDEAEHETNESLEAAKAKIIKAFPGLEECKDPTYHYEVNCLEYRPGTNVPVTGGMYVPRYTQLNLSAD
            ******::  *  :**  ***  :*:    *  **:  *. :.   ****:****  ***: ** *******:**** . **

PRIM.CONS.  AFIDEADHKTEESLKAAKAKIF2AFPGLEECKDSTYHYEVNCLEYRPGTGVPVTGGMYVPQYTQLSLNAD 920        930        940        950        960        970        980
                      |          |          |          |          |          |          |
SEQID3      TAKAMVQAADLGTNIQRLYQHELYFRTNGRKGERLSSVDLERLYQNMSVWLWNKIEYRYENDKDDELGFK
SEQID4      TAKAMVQAADLGTNIQRLYQHELYFRTNGRKGERLSSVDLERLYQNMSVWLWNKIEYRYENDKDDELGFK
SEQID12     TAKAMVQAADLGTNIQRLYQHELYFRTNGRKGERLSSVDLERLYQNMSVWLWNEIEYSYDSSKEDELGFK
SEQID16     TAKAMVQAADLGTNIQRLYQHELYFRTNGRKGERLSSVDLERLYQNMSVWLWNKIEYRYENDKDDELGFK
SEQID5      TAKAMVQAADLGTNIQRLYQHELYFRTNGRKGERLSSVDLERLYQNMSVWLWNDTSYRYEEGKNDELGFK
SEQID14     TAKAMVQAADLGTNIQRLYQHELYFRTNGRKGERLSSVDLERLYQNMSVWLWNDTSYRYEEGKNDELGFK
SEQID6      TAKAMVQAADLGTNIQRLYQHELYFRTNGRKGERLSCVDLERLYQNMSVWLWNDTSYRYEEGKNDELGFK
SEQID8      TAKAMVQAADLGTNIQRLYQHELYFRTNGRKGERLSSVDLERLYQNMSVWLWNDTSYRYEEGKNDELGFK
SEQID9      TAKAMLQAADLGTNIQRLYQHELYFRTNGRQGERLNSVDLERLYQNMSVWLWNETKYRYEEGKEDELGFK
SEQID11     TAKAMLQAADLGTNIQRLYQHELYFRTNGRQGERLNSVDLERLYQNMSVWLWNETKYRYEEGKEDELGFK
SEQID7      TAKAMLQAADLGTNIQRLYQHELYFRTNGRQGERLNSVDLERLYQNMSVWLWNETKYRYEEGKEDELGFK
SEQID13     TAKAMVQAADLGTNIQRLYQHELYFRTNGRKGERLSSVDLERLYQNMSVWLWNKIEYRYENDKDDELGFK
SEQID15     TAKAMVQAADLGTNIQRLYQHELYFRTNGRKGERLSSVDLERLYQNMSVWLWNKIEYRYENDKDDELGFK
SEQID2      TAKAMVQAADLGTNIQRLYQHELYFRTKGSKGERLNSVDLERLYQNMSVWLWNDTKYRYEEGKEDELGFK
SEQID10     TAKAMVQAADLGTNIQRLYQHELYFRTNGRKGERLSSVDLERLYQNMSVWLWNEIEYSYDSSKEDELGFK
            *****:********************:*  :****..**************. * *:..*:******

PRIM.CONS.  TAKAMVQAADLGTNIQRLYQHELYFRTNGRKGERLSSVDLERLYQNMSVWLWN3TEYRYEEGKEDELGFK
```

FIG. 1H

```
                    990       1000      1010      1020      1030      1040      1050
                     |         |         |         |         |         |         |
SEQID3      TFTEFLNCYANDAYTGGTQCSDELKKSLVDNNMIYGEKSVNKAGMMNPSYPLNYMEKPLTRLMLGRSWWD
SEQID4      TFTEFLNCYANDAYTGGTQCSDELKKSLVDNNMIYGEKSVNKAGMMNPSYPLNYMEKPLTRLMLGRSWWD
SEQID12     TFTEFLNCYANDAYTGGTQCSDELKKSLVDNNMIYGEKSVNKAGMMNPSYPLNYMEKPLTRLMLGRSWWD
SEQID16     TFTEFLNCYANNAYSEGTQCSADLKKSLVDNNMIYGDGSS-KAGMMNPSYPLNYMEKPLTRLMLGRSWWD
SEQID5      TFTEFLNCYANDAYAGGTKCSADLKKSLVDNNMIYGDGSS-KAGMMNPSYPLNYMEKPLTRLMLGRSWWD
SEQID14     TFTEFLNCYANDAYAGGTKCSADLKKSLVDNNMIYGDGSS-KAGMMNPSYPLNYMEKPLTRLMLGRSWWD
SEQID6      TFTEFLNCYANDAYAGGTKCSADLKKSLVDNNMIYGDGSS-KAGMMNPSYPLNYMEKPLTRLMLGRSWWD
SEQID8      TFTEFLNCYANDAYAGGTKCSADLKKSLVDNNMIYGDGSS-KAGMMNPSYPLNYMEKPLTRLMLGRSWWD
SEQID9      TFTEFLNCYTNNAYVG-TQCSAELKKSLIDNKMIYGEESS-KAGMMNPSYPLNYMEKPLTRLMLGRSWWD
SEQID11     TFTEFLNCYTNNAYVG-TQCSAELKKSLIDNKMIYGEESS-KAGMMNPSYPLNYMEKPLTRLMLGRSWWD
SEQID7      TFTEFLNCYTNNAYVG-TQCSAELKKSLIDNKMIYGEESS-KAGMMNPSYPLNYMEKPLTRLMLGRSWWD
SEQID13     TFTEFLNCYANNAYDGGTQCSAELKQSLIDNKMIYGE-GS-KAGMMNPSYPLNYMEKPLTRLMLGRSWWD
SEQID15     TFTEFLNCYANNAYDGGTQCSAELKQSLIDNKMIYGE-GS-KAGMMNPSYPLNYMEKPLTRLMLGRSWWD
SEQID2      TFTEFLNCYANDAYAGGTKCSADLKKSLVDNNMIYGDGSS-KAGMMNPSYPLNYMEKPLTRLMLGRSWWD
SEQID10     TFTEFLNCYANDAYTKGTLCSAELKQSLIDNKMIYGEGS--KAGMMNPSYPLNYMEKPLTRLMLGRSWWD
            *********:*:**  *  ** :**:**:**:****:   ******************************
PRIM.CONS.  TFTEFLNCYANDAYAGGTQCSAELKKSLVDNNMIYGEGSSNKAGMMNPSYPLNYMEKPLTRLMLGRSWWD 1060      1070      1080      1090      1100      1110      1120
                     |         |         |         |         |         |         |
SEQID3      LNIKVDVEKYPGAVSAEGEKVTETISLYSNPTKWFAGNMQSTGLWAPAQKEVTIESSASVPVTVTVALAD
SEQID4      LNIKVDVEKYPGAVSAEGEKVTETISLYSNPTKWFAGNMQSTGLWAPAQKEVTIESTASVAVTVTVALAD
SEQID12     LNIKVDVEKYPGAVSEEGEQVTPESISLYSNPTKWFAGNMQSTGLWAPAQKEVTIKSNADVPVTVTVALAD
SEQID16     LNIKVDVEKYPGAVSAEGEKVTETISLYSNPTKWFAGNMQSTGLWAPAQQEVTIESTASVPVTVTVALAD
SEQID5      LNIKVDVEKYPGAVSEEGQNVTETISLYSNPTKWFAGNMQSTGLWAPAQKEVTIKSNANVPVTVTVALAD
SEQID14     LNIKVDVEKYPGAVSEEGQNVTETISLYSNPTKWFAGNMQSTGLWAPAQKEVTIKSNANVPVTVTVALAD
SEQID6      LNIKVDVEKYPGAVSEEGQNVTETISLYSNPTKWFAGNMQSTGLWAPAQKEVTIKSNANVPVTVTVALAD
SEQID8      LNIKVDVEKYPGAVSEEGQNVTETISLYSNPTKWFAGNMQSTGLWAPAQKEVTIKSNANVPVTVTVALAD
SEQID9      LNIKVDVEKYPGVVNTNGETVTQNINLYSAPTKWFAGNMQSTGLWAPAQQEVSIESKATVPVTVTVALAD
SEQID11     LNIKVDVEKYPGVVNTNGETVTQNINLYSAPTKWFAGNMQSTGLWAPAQQEVSIESKSTVPVTVTVALAD
SEQID7      LNIKVDVEKYPGAVSEEGQNVTETISLYSNPTKWFAGNMQSTGLWAPAQKEVTIKSNANVPVTVTVALAD
SEQID13     LNIKVDVEKYPGAVSAEGEEVTETINLYSNPTKWFAGNMQSTGLWAPAQQEVSIKSNAKVPVTVTVALAD
SEQID15     LNIKVDVEKYPGAVSAEGEEVTETINLYSNPTKWFAGNMQSTGLWAPAQQEVSIKSNAKVPVTVTVALAD
SEQID2      LNIKVDVEKYPGSVSAKGESVTENISLYSNPTKWFAGNMQSTGLWAPAQQDVTIKSSASVPVTVTVALAD
SEQID10     LNIKVDVEKYPGAVSVGGEEVTETISLYSNPTKWFAGNMQSTGLWAPAQKEVTIKSNANVPVTVTVALAD
            ***********.*. *: **:.*.*** ******************::*:*:.: *.*********
PRIM.CONS.  LNIKVDVEKYPGAVS2EGENVTETISLYSNPTKWFAGNMQSTGLWAPAQKEVTIKSNANVPVTVTVALAD
```

FIG. 1I

```
                 1130      1140      1150      1160      1170      1180      1190
                   |         |         |         |         |         |         |
SEQID3    DLTGREKHEVALNRPPKVTKTYELKANGEVKFTVPYGGLIYIKGNSPQN-ESAEFTFTGVVKAPFYKDGA
SEQID4    DLTGREKHEVALNRPPKVTKTYELKANGEVKFTVPYGGLIYIKGNSPQN-ESAEFTFTGVVKAPFYKDGA
SEQID12   DLTGREKHEVALNRPPKVTKTYELKANGEVKFTVPYGGLIYIKGNSKENNKSASFTFTGVVKAPFYKNGA
SEQID16   DLTGREKHEVALNRPPKVTKTYDLKANDKVTFKVPYGGLIYIKGNSPKN-ESAEFTFTGVVKAPFYKDGE
SEQID5    DLTGREKHEVALNRPPRVTKTYSLDASGTVKFKVPYGGLIYIKGNSSTN-ESASFTFTGVVKAPFYKDGA
SEQID14   DLTGREKHEVALNRPPRVTKTYSLDASGTVKFKVPYGGLIYIKGNSSTN-ESASFTFTGVVKAPFYKDGA
SEQID6    DLTGREKHEVALNRPPRVTKTYSLDASGTVKFKVPYGGLIYIKGNSSTN-ESASFTFTGVVKAPFYKDGA
SEQID8    DLTGREKHEVALNRPPRVTKTYSLDASGTVKFKVPYGGLIYIKGNSSTN-ESASFTFTGVVKAPFYKDGA
SEQID9    DLTGREKHEVSLNRPPRVTKTYDLKANDKVTFKVPYGGLIYIKGDSKEV-QSADFTFTGVVKAPFYKDGK
SEQID11   DLTGREKHEVSLNRPPRVTKTYDLKANDKVTFKVPYGGLIYIKGDSKEV-QSADFTFTGVVKAPFYKDGK
SEQID7    DLTGREKHEVALNRPPRVTKTYSLDASGTVKFKVPYGGLIYIKGNSSTN-ESASFTFTGVVKAPFYKDGA
SEQID13   DLTGREKHEVALNRPPRVTKTYSLDASGTVKFKVPYGGLIYIKSDSKEE-KSANFTFTGVVKAPFYKDGK
SEQID15   DLTGREKHEVALNRPPRVTKTYSLDASCTVKFKVPYGGLIYIKSDSKEE-KSANFTFTGVVKAPFYKDGK
SEQID2    DLTGREKHEVALNRPPRVTKTYTLEANGEVTFKVPYGGLIYIKGDSKDD-VSANFTFTGVVKAPFYKDGE
SEQID10   DLTGREKHEVALNRPPRVTKTYSLDASGTVKFKVPYGGLIYIKGNSSTN-ESASFTFTGVVKAPFYKDGA
          **********:*****:***** *.*.. *.*.**********.:*   **.**************.*.
PRIM.CONS. DLTGREKHEVALNRPPRVTKTYSLDASGTVKFKVPYGGLIYIKGNS2TNNESASFTFTGVVKAPFYKDGA 1200      1210      1220      1230      1240      1250      1260
                   |         |         |         |         |         |         |
SEQID3    WKNALNSPAPLGELESDAFVYTTPKKNLEAS---NFTGGVAEFAKDLDTFASSMNDFYGRNDEDGKHRMF
SEQID4    WKNALNSPAPLGELESDAFVYTTPKKNLEAS---NYKGGQEQFAEELDTFASSMNDFYGRNDEDGKHRMF
SEQID12   WKNALNSPAPLGELESDAFVYTTPKKNLEAS---NFTGGVAEFAKDLDTFASSMNDFYGRNDEDGKHRMF
SEQID16   WKNALNSPAPLGELESDSFVYTAPKNNLNASNYSNYTDGVAEFAKELDTFASSMNDFYGRDESGNHRMF
SEQID5    WKNDLNSPAPLGELESDAFVYTTPKKNLNAS---NYTGGLEQFANDLDTFASSMNDFHGRDSEDGKHRMF
SEQID14   WKNDLNSPAPLGELESDAFVYTTPKKNLNAS---NYTGGLEQFANDLDTFASSMNDFYGRDSEDGKHRMF
SEQID6    WKNDLNSPAPLGELESDAFVYTTPKKNLNAS---NYTGGLEQFANDLDTFASSMNDFYGRDEDGKHRMF
SEQID8    WKNDLNSPAPLGELESDAFVYTTPKKNLNAS---NYTGGLEQFANDLDTFASSMNDFYGRDETSGKHRMF
SEQID9    WQHDLNSPAPLGELESASFVYTTPKKNLNAS---NYTGGLEQFANDLDTFASSMNDFYGRDSEDGKHRMF
SEQID11   WQHDLNSPAPLGELESASFVYTTPKKNLNAS---NYTGGLEQFANDLDTFASSMNDFYGRDSEDGKHRMF
SEQID7    WKNDLNSPAPLGELESDAFVYTTPKKNLNAS---NYTGGLEQFANDLDTFASSMNDFYGRDSESGKHRMF
SEQID13   WKNDLKSPAPLGELESASFVYTTPKKNLEAS---NYKGGLKQFAEDLDTFASSMNDFYGRDGESGKHRMF
SEQID15   WKNDLKSPAPLGELESASFVYTTPKKNLEAS---NYKGGLKQFAEDLDTFASSMNDFYGRDGESGKHRMF
SEQID2    WKNDLDSPAPLGELESASFVYTTPKKNLEAS---NFTGGVAEFAKDLDTFASSMNDFYGRNDEDGKHRMF
SEQID10   WKNDLNSPAPLGELESASFVYTTPKKNLNAS---NYTGGLDQFAKDLDTFASSMNDFYGRDSEDGKHRMF
          *:: *.*********  :****:**:**:**   *:..*  :**::**********:**:  .*:****
PRIM.CONS. WKNDLNSPAPLGELESDAFVYTTPKKNLNASNYSNYTGGLEQFANDLDTFASSMNDFYGRDSEDGKHRMF
```

FIG. 1J

```
                  1270       1280       1290       1300       1310       1320       1330
                    |          |          |          |          |          |          |
SEQID3      TYKNLTGHKHRFTNDVQISIGDAHSGYPVMNSSFSTNSTTLPTTPLNDWLIWHEVGHNAAETPLTVPGAT
SEQID4      TYKNLTGHKHRFTNDVQISIGDAHSGYPVMNSSFSTNSTTLPTTPLNDWLIWHEAGHNAAETPLTVPGAT
SEQID12     TYKNLTGHKHRFTNDVQISIGDAHSGYPVMNSSFSTNSTTLPTTPLNDWLIWHEVGHNAAETPLTVPGAT
SEQID16     TYKALTGHKHRFANDVQISIGDAHSGYPVMNSSFSTNSTTLPTTPLNDWLIWHEVGHNAAETPLNVPGAT
SEQID5      TYKNLPGHKHRFTNDVQISIGDAHSGYPVMNSSFSPNSTTLPTTPLNDWLIWHEVGHNAAETPLTVPGAT
SEQID14     TYKNLPGHKHRFTNDVQISIGDAHSGYPVMNSSFSPNSTTLPTTPLNDWLIWHEVGHNAAETPLTVPGAT
SEQID6      TYKNLPGHKHRFANDVQISIGDAHSGYPVMNSSFSPNSTTLPTTPLNDWLIWHEVGHNAAETPLTVPGAT
SEQID8      TYKNLTGHKHRFTNDVQISIGDAHSGYPVMNSSFSTNSTTLPTTPLNDWLIWHEVGHNAAETPLTVPGAT
SEQID9      TYKNLPGHKHRFANDVQISIGDAHSGYPVMNSSFSPNSTTLPTTPLNDWLIWHEVGHNAAETPLTVPGAT
SEQID11     TYKNLPGHKHRFANDVQISIGDAHSCYPVMNSSFSPNSTTLPTTPLNDWLIWHEVGHNAAETPLTVPGAT
SEQID7      TYKNLTGHKHRFANDVQISIGDAHSGYPVMNSSFSPNSTTLPTTPLNDWLIWHEVGHNAAETPLTVPGAT
SEQID13     TYEALTGHKHRFTNDVQISIGDAHSGYPVMNSSFSPNSTTLPTTPLNDWLIWHEVGHNAAETPLTVPGAT
SEQID15     TYEALTGHKHRFTNDVQISIGDAHSGYPVMNSSFSPNSTTLPTTPLNDWLIWHEVGHNAAETPLTVPGAT
SEQID2      TYKNLTGHKHRFTNDVQISIGDAHSGYPVMNSSFSTNSTTLPTTPLNDWLIWHEVGHNAAETPLNVPGAT
SEQID10     TYKNLTGHKHRFTNDVQISIGDAHSGYPVMNSSFSTNSTTLPTTPLNDWLIWHEVGHNAAETPLNVPGAT
            **: *.******:********************.*****************.********.*****

PRIM.CONS.  TYKNLTGHKHRFTNDVQISIGDAHSGYPVMNSSFSPNSTTLPTTPLNDWLIWHEVGHNAAETPLTVPGAT 1340       1350       1360       1370       1380       1390       1400
                    |          |          |          |          |          |          |
SEQID3      EVANNVLALYMQDRYLGKMNRVADDITVAPEYLEESNGQAWARGGAGDRLLMYAQLKEWAERNFDIKQWY
SEQID4      EVANNVLALYMQDRYLGKMNRVADDITVAPEYLEESNNQAWARGGAGDRLLMYAQLKEWAERNFDITKWY
SEQID12     EVANNVLALYMQDRYLGKMNRVADDITVAPEYLEESNNQAWARGGAGDRLLMYAQLKEWAERNFDIKKWY
SEQID16     EVANNVLALYMQDRYLGKMNRVADDITVAPEYLDESNGQAWARGGAGDRLLMYAQLKEWAEENFDIKQWY
SEQID5      EVANNVLALYMQDRYLGKMNRVADDITVAPEYLEESNNQAWARGGAGDRLLMYAQLKEWAERNFDIKKWY
SEQID14     EVANNVLALYMQDRYLGKMNRVADDITVAPEYLEESNNQAWARGGAGDRLLMYAQLKEWAERNFDIKKWY
SEQID6      EVANNVLALYMQDRYLGKMNRVADDITVAPEYLEESNGQAWARGGAGDRLLMYAQLKEWAERNFDIKKWY
SEQID8      EVANNVLALYMQDRYLGKMNRVADDITVAPEYLEESNGQAWARGGAGDRLLMYAQLKEWAERNFDIKKWY
SEQID9      EVANNVLALYMQDRYLGKMNRVADDITVAPEYLEESNGQAWARGGAGDRLLMYAQLKEWAERNFDIKKWY
SEQID11     EVANNVLALYMQDRYLGKMNRVADDITVAPEYLEESNGQAWARGGAGDRLLMYAQLKEWAERNFDIKKWY
SEQID7      EVANNVLALYMQDRYLGKMNRVADDITVAPEYLEESNGQAWARGGAGDRLLMYAQLKEWAERNFDIKKWY
SEQID13     EVANNVLALYMQDRYLGKMNRVADDITVAPEYLEESNGQAWARGGAGDRLLMYAQLKEWAERNFDIKQWY
SEQID15     EVANNVLALYMQDRYLGKMNRVADDITVAPEYLEESNGQAWARGGAGDRLLMYAQLKEWAERNFDIKQWY
SEQID2      EVANNVLALYMQDRYLGKMNRVADDITVAPEYLDESNGQAWARGGAGDRLLMYAQLKEWAEENFDIKQWY
SEQID10     EVANNVLALYMQDRYLGKMNRVADDITVAPEYLDESNGQAWARGGAGDRLLMYAQLKEWAERNFDITKWY
            ********************************:***.********************:****.:**

PRIM.CONS.  EVANNVLALYMQDRYLGKMNRVADDITVAPEYLEESNGQAWARGGAGDRLLMYAQLKEWAERNFDIKKWY
```

FIG. 1K

```
                       1410      1420      1430      1440      1450      1460      1470
                         |         |         |         |         |         |         |
SEQID3       PEGD-LPKFYSDREGMKGWNLFQLMHRKARGDEVGKTKFGERNYCAESNGNAADKLMLCASWVAQTDLSE
SEQID4       PEGN-LPKFYSEREGMKGWNLFQLMHRKARGDEVGKTKFGERNYCAESNGNAADTLMLCASWVAQTDLSA
SEQID12      PDGTPLPEFYSEREGMKGWNLFQLMHRKARGDEVSNDKFGGRNYCAESNGNTADTLMLCASWVAQTDLSE
SEQID16      PDGE-LPKFYSDRKGMKGWNLFQLMHRKARGDDVSNDKFGGRNYCAESNGNAADTLMLCASWVAQADLSE
SEQID5       PDGTPLPEFYSEREGMKGWNLFQLMHRKARGDEVSNDKFGGKNYCAESNGNAADTLMLCASWVAQTDLSE
SEQID14      PDGTPLPEFYSEREGMKGWNLFQLMHRKARGDEVSNDKFGGKNYCAESNGNAADTLMLCASWVAQTDLSE
SEQID6       PDGTPLPEFYSEREGMKGWNLFQLMHRKARGDEVSNDKFGGKNYCAESNGNAADTLMLCASWVAQTDLSE
SEQID8       PEGE-LPKFFSDREGMKGWNLFQLMHRKARGDDVGDKTFGGKNYCAESNGNAADTLMLCASWVAQTDLSA
SEQID9       PDGTPLPEFYSEREGMKGWNLFQLMHRKARGDEVSNDKFGGKNYCAESNGNAADTLMLCASWVAQTDLSE
SEQID11      PDGTPLPEFYSEREGMKGWNLFQLMHRKARGDEVSNDKFGGKNYCAESNGNAADTLMLCASWVAQTDLSE
SEQID7       PEGE-LPKFFSDREGMKGWNLFQLMHRKARGDDVGNKTFGGKNYCAESNGNAADSLMLCASWVAQTDLSA
SEQID13      PEGS-LPAFYSEREGMKGWNLFQLMHRKARGDDVGNDKFGNRNYCAESNGNAADTLMLCASWVAQTDLSA
SEQID15      PEGS-LPAFYSEREGMKGWNLFQLMHRKARGDDVGNDKFGNRNYCAESNGNAADTLMLCASWVAQTDLSA
SEQID2       PDGE-LPKFYSDRKGMKGWNLFQLMHRKARGDDVGNSTFGGRNYCAESNGNAADTLMLCASWVAQADLSE
SEQID10      PDGK-LPAFYSEREGMKGWNLFQLMHRKARGDDVGNSTFGGKNYCAESNGNAADTLMLCASWVAQTDLSE
             *:*  ** *:*:*:*****************:*.. .** :*********:**.**********:***
PRIM.CONS.   PDGTPLP2FYSEREGMKGWNLFQLMHRKARGDEVGNDKFGGKNYCAESNGNAADTLMLCASWVAQTDLSE 1480      1490      1500      1510      1520      1530
                         |         |         |         |         |         |
SEQID3       FFKKWNPGANAYQLPGASEMNFEGGVSQSAYETLAALNLPKPQQGPETINQVTEHKMSAE
SEQID4       FFKKWNPGANAYQLPGASEMNFEGGVSQSAYETLAALNLPKPQQGPETINKVTEYSMPAE
SEQID12      FFKKWNPGANAYQLPGATEMSFEGGVSQSAYNTLASLDLPKPRQGPETINKVTEYSMPAE
SEQID16      FFKKWNPGANAYQLPGASEMSFEGGVSQSAYNTLAAMHLSKPEKGPETINKVTEYSMPAE
SEQID5       FFKKWNPGANAYQLPGASEMSFEGGVSQSAYNTLASLDLPKPEQGPETINQVTEHKMSAE
SEQID14      FFKKWNPGANAYQLPGASEMSFEGGVSQSAYNTLASLDLPKPEQGPETINQVTEHKMSAE
SEQID6       FFKKWNPGANAYQLPGASEMSFEGGVSQSAYNTLASLKLPKPEQGPETINKVTEHKMSVE
SEQID8       FFKKWNPGANAYQLPGATEMSFEGGVSQSAYSTLASLKLPKPEQGPETINKVTEHKMSLE
SEQID9       FFKKWNPGANAYQLPGASEMSFEGGVSQSAYNTLASLKLPKPEQGPETINKVTEHKMSVE
SEQID11      FFKKWNPGANAYQLPGASEMSFEGGVSQSAYNTLASLDLPKPEQGPETINQVTEHKMSAE
SEQID7       FFKKWNPGANAYQLPGATEMSFEGGVSQSAYSTLASLKLPKPEQGPETINKVTEHKMSLE
SEQID13      FFKKWNPGANAYQLPGATEMSFEGGVSQSAYNTLASLDLPKPRQGPETINKVTEYSMPAE
SEQID15      FFKKWNPGANAYQLPGATEMSFEGGVSQSAYNTLASLDLPKPEQGPETINQVTEHKMSAE
SEQID2       FFKKWNPGASAYQLPGATEMSFQGGVSSSAYSTLASLKLPKPEKGPETINKVTEHKMSAE
SEQID10      FFKKWNPGANAYQLPGAAEMSFEGGVSSSAYSTLASLNLPKPEKGPETINKVTEHKMSAE
             *********.*******:**.*:****.***.***::.*.**::******:***:.*.*
PRIM.CONS.   FFKKWNPGANAYQLPGASEMSFEGGVSQSAYNTLASLDLPKPEQGPETINKVTEHKMSAE
```

FIG. 2

| MG1655 | 14 | 13 | RS218 | 2 | APECO1 | 4 | UTI89 | 10 | 3 | 12 | 5 | 16 | 8 | 7 | 6 | 9 | 11 | 15 | STRAINS |
|---|---|---|---|---|---|---|---|---|---|---|---|---|---|---|---|---|---|---|---|
| 100 | 100 | 93.4 | 88 | 88 | 88 | 92.2 | 88 | 89.2 | 92.2 | 90.5 | 99.9 | 91.4 | 97.3 | 92.5 | 98.4 | 92.5 | 92.4 | 93.7 | DH10B |
| | 100 | 93.4 | 88 | 88 | 88 | 92.2 | 88 | 89.2 | 92.2 | 90.5 | 99.9 | 91.4 | 97.3 | 92.5 | 98.4 | 92.5 | 92.4 | 93.7 | MG1655 |
| | | 93.4 | 88 | 88 | 88 | 92.2 | 88 | 89.2 | 92.2 | 90.5 | 99.9 | 91.4 | 97.3 | 92.5 | 98.4 | 92.5 | 92.4 | 93.7 | 14 |
| | | | 87.6 | 87.6 | 87.6 | 90.2 | 87.6 | 88.9 | 89.7 | 89.6 | 93.4 | 90.8 | 92.3 | 93.6 | 92.2 | 93.2 | 93.9 | 99.6 | 13 |
| | | | | 100 | 100 | 85.9 | 100 | 94.1 | 86.6 | 86.1 | 88 | 89.6 | 88.2 | 87.9 | 87.8 | 86.7 | 87.7 | 86.7 | RS218 |
| | | | | | 100 | 85.9 | 100 | 94.1 | 86.6 | 86.2 | 88 | 89.6 | 88.2 | 87.9 | 87.8 | 86.7 | 87.8 | 87.7 | 2 |
| | | | | | | 85.9 | 100 | 94.1 | 86.6 | 86.2 | 88 | 89.6 | 88.2 | 87.9 | 87.8 | 86.7 | 87.8 | 87.7 | APECO1 |
| | | | | | | | 85.9 | 86.9 | 98.3 | 94.4 | 92.1 | 91.3 | 92 | 88.1 | 91.9 | 88.7 | 87.1 | 89.9 | 4 |
| | | | | | | | | 94.1 | 86.6 | 86.2 | 88 | 89.6 | 88.2 | 87.9 | 87.8 | 86.7 | 87.8 | 87.7 | UTI89 |
| | | | | | | | | | 86.7 | 86.9 | 89.1 | 88.1 | 89 | 89.4 | 88.8 | 87.1 | 88.2 | 89.1 | 10 |
| | | | | | | | | | | 94.9 | 92.1 | 91.6 | 92 | 88.2 | 91.9 | 88.7 | 87.3 | 89.9 | 3 |
| | | | | | | | | | | | 90.5 | 90 | 89.5 | 87.9 | 90.2 | 88.8 | 87.7 | 89.2 | 12 |
| | | | | | | | | | | | | 91.3 | 97.2 | 92.4 | 98.4 | 92.4 | 92.4 | 93.6 | 5 |
| | | | | | | | | | | | | | 91.3 | 88.9 | 91.5 | 89.9 | 88.8 | 90.6 | 16 |
| | | | | | | | | | | | | | | 94.5 | 98.6 | 92.4 | 89.9 | 92.4 | 8 |
| | | | | | | | | | | | | | | | 93.7 | 94.3 | 95.0 | 93.7 | 7 |
| | | | | | | | | | | | | | | | | 93.7 | 91.2 | 92.3 | 6 |
| | | | | | | | | | | | | | | | | | 96.4 | 93.3 | 9 |
| | | | | | | | | | | | | | | | | | | 94.1 | 11 |

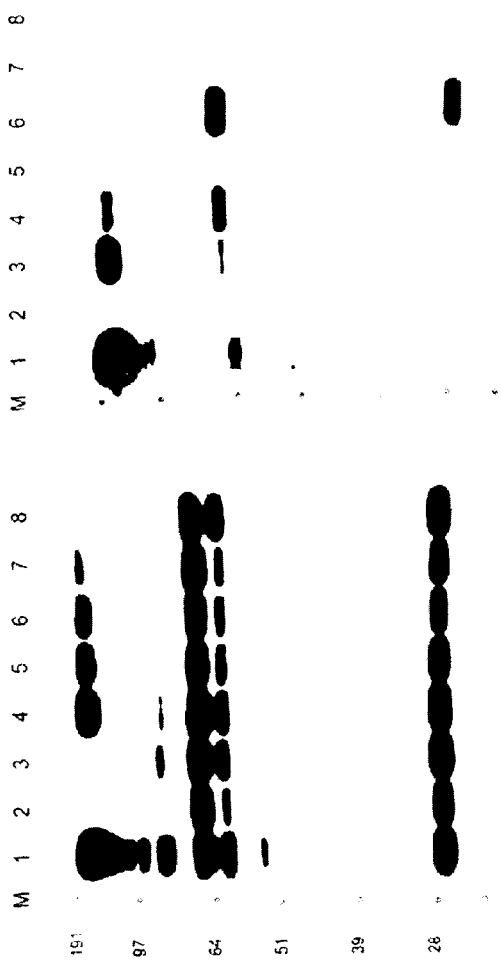

4-12% MOPS    37°C

25°C

US 8,871,214 B2

DETOXIFIED *ESCHERICHIA COLI* IMMUNOGENS

CROSS REFERENCE TO RELATED APPLICATIONS

This application is a U.S. National Phase patent application of PCT/IB2010/002043, filed Jul. 16, 2010, which claims priority to U.S. provisional patent application Ser. No. 61/226,219, filed Jul. 16, 2009, and U.S. provisional patent application Ser. No. 61/290,654, filed Dec. 29, 2009, all of which are hereby incorporated by reference in the present disclosure in their entirety.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 529552004200SEQLIST.txt, date recorded: Mar. 19, 2014, size: 893 KB).

TECHNICAL FIELD

This invention relates to immunisation against pathogenic *Escherichia coli* strains.

BACKGROUND

*E. coli* strains have traditionally been classified as either commensal or pathogenic, and pathogenic strains are then sub-classified as intestinal or extraintestinal strains. Pathogenic *E. coli* are discussed in more detail in reference 1, and fall into a number of different pathotypes i.e. a group of *E. coli* strains that cause a common disease using a common set of virulence factors. Pathotyping of strains is a routine technique that can be performed genotypically or phenotypically. One recent genotype-based pathotyping method [2] uses a DNA microarray.

Among intestinal strains at least six well-described pathotypes are known: enteropathogenic (EPEC), enterohaemorrhagic (EHEC), enteroaggregative (EAEC), enteroinvasive (EIEC), enterotoxigenic (ETEC) and diffusely adherent (DAEC).

The extraintestinal pathogenic strains (or 'ExPEC' strains [3,4]) of *E. coli* include uropathogenic (UPEC) strains, neonatal meningitis (NMEC) strains, and septicemia-associated strains (SEPEC). ExPEC is the most common cause of urinary tract infections and one of the leading causes of neonatal meningitis and neonatal sepsis in humans, which can lead to serious complications and death. Other types of extraintestinal infections include osteomyelitis, pulmonary, intra-abdominal, soft tissue, and intravascular device-associated infections. Another ExPEC pathotype outside humans is avian pathogenic (APEC), causing extraintestinal infections in poultry.

Most previous ExPEC vaccines have been based on cell lysates or on cellular structures. SOLCOUROVAC™ includes ten different heat-killed bacteria including six ExPEC strains. URO-VAXOM™ is an oral tablet vaccine containing lyophilised bacterial lysates of 18 selected *E. coli* strains. Baxter Vaccines developed a UTI vaccine based on pili from 6 to 10 different strains. MedImmune developed a product called MEDI 516 based on the FimH adhesin complex. In contrast, references 5 and 6 disclose specific immunogens from ExPEC strains that can be used as the basis of defined vaccines against both NMEC and UPEC strains.

It is an object of the invention to provide further and better antigens for use in immunisation against pathogenic *E. coli* strains, and more particularly against intestinal pathotypes (e.g. EAEC, EIEC, EPEC and ETEC strains) as well as ExPEC pathotypes and in particular antigen that have been detoxified so as to enable their use as components for immunisation or that have been shortened without reducing the immune response raised to as to improve the expression and purification.

DISCLOSURE OF THE INVENTION

One of the many antigens disclosed in reference 5 is annotated as the accessory colonization factor D ("AcfD") precursor (orf3526) (SEQ ID NOs: 7051 & 7052 therein; SEQ ID NO: 1 herein). Reference 5 discloses the sequence from NMEC strain IHE3034, and the present invention is based on variants of the ExPEC 'AcfD precursor' (orf3526) that have been identified in further pathotypes, including APEC, UPEC, EAEC, EIEC, EPEC and ETEC strains. Unlike the disclosure of reference 5, these variants can be particularly useful for treating intestinal pathotypes. Thus the invention provides such variants, together with their use in immunising patients against *E. coli* infections. In addition, this disclosure includes fragments and mutants of the AcfD (orf3526) protein of all *E. coli* pathotypes where the fragment has increased solubility as compared to the full length while raising a substantially similar immune response in a subject as that raised by the full length protein. Further, this disclosure includes fragments and mutants of the AcfD (orf3526) protein of all *E. coli* pathotypes where the fragment has decreased toxicity as compared to the full length protein while raising a substantially similar immune response in a subject as that raised by the full length protein. In addition, this disclosure includes fragments and mutants of the Acfn (orf3526) protein of all *E. coli* pathotypes where the fragment raises a substantially similar immune response in a subject as that raised by the full length protein while having improved characteristics with regard to purification when expressed in *E. coli*.

Polypeptides Used with the Invention

The invention provides an immunogenic polypeptide comprising an *E. coli* AcfD (orf3526) polypeptide comprising a mutation relative to the *E. coli* AcfD (orf3526) protein which decreases the toxicity of the immunogenic polypeptide as compared to the *E. coli* AcfD (orf3526) protein and wherein the immunogenic polypeptide raises a substantially similar immune response in a subject as the *E. coli* AcfD (orf3526) protein.

The *E. coli* AcfD (orf3526) protein may have an amino acid sequence selected from the group consisting of SEQ ID NOs: 1-19.

Exemplary mutations that decrease the toxicity include a deletion of all or a portion of the zincin metalloprotease domain and a point mutation in zincin metalloprotease domain which reduces the protease activity. In certain cases, the point mutation is a mutation of a zinc binding residue or a mutation of a catalytic residue. A preferred point mutation is substitution of amino acid number 1305 based upon alignment with SEQ ID NO: 1.

Exemplary deletions include removal of at least the last 100 C-terminal amino acids of the *E. coli* AcfD (orf3526) protein, at least the last 200 C-terminal amino acids of the *E. coli* AcfD (orf3526) protein, at least the last 300 C-terminal amino acids of the *E. coli* AcfD (orf3526) protein, at least the last 400 C-terminal amino acids of the *E. coli* AcfD (orf3526)

protein, at least the last 500 C-terminal amino acids of the *E. coli* AcfD (orf3526) protein, at least the last 600 C-terminal amino acids of the *E. coli* AcfD (orf3526) protein, at least the last 700 C-terminal amino acids of the *E. coli* AcfD (orf3526) protein, at least the last 750 C-terminal amino acids of the *E. coli* AcfD (orf3526) protein, or at least the last 758 C-terminal amino acids of the *E. coli* AcfD (orf3526) protein or does not comprise at least the first 100 N-terminal amino acids of the *E. coli* AcfD (orf3526) protein, at least the first 200 N-terminal amino acids of the *E. coli* AcfD (orf3526) protein, at least the first 300 N-terminal amino acids of the *E. coli* AcfD (orf3526) protein, at least the first 400 N-terminal amino acids of the *E. coli* AcfD (orf3526) protein, at least the first 500 N-terminal amino acids of the *E. coli* AcfD (orf3526) protein, at least the first 600 N-terminal amino acids of the *E. coli* AcfD (orf3526) protein, at least the first 700 N-terminal amino acids of the *E. coli* AcfD (orf3526) protein, at least the first 750 N-terminal amino acids of the *E. coli* AcfD (orf3526) protein, or at least the first 760 N-terminal amino acids of the *E. coli* AcfD (orf3526) protein.

The invention provides an immunogenic polypeptide comprising an *E. coli* AcfD (orf3526) polypeptide wherein the immunogenic polypeptide comprises an amino acid sequence that comprises:
  (a) the amino acid sequence selected from the group consisting of SEQ ID NOs 20 to 76;
  (b) at least α% sequence identity to any one of SEQ ID NOs: 20 to 76; or
  (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or;
  (d) when aligned with any of SEQ ID NOs: 20 to 76 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer,
  wherein the immunogenic polypeptide comprises a mutation relative to the *E. coli* ACID (orf3526) protein which decreases the toxicity of the immunogenic polypeptide as compared to the *E. coli* AcfD (orf3526) protein and wherein the immunogenic polypeptide raises a substantially similar immune response in a subject as the *E. coli* AcfD (orf3526) protein.

The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include other detoxified variants of SEQ ID NOs 20 to 76, including allelic variants, polymorphic forms, homologs, orthologs, paralogs, mutants, etc.

The value of α may be selected from 50%, 60%, 65%, 70%, 75%, 80%, 85%, 87.5%, 90%, 91%, 92%, 93%, 94%, 95%, 96%, 97%, 98%, 99%, 99.5% or more.

The foregoing immunogenic polypeptides may further contain a deletion relative to the *E. coli* AcfD (orf3526) protein which increases solubility of the immunogenic polypeptide as compared to the *E. coli* AcfD (orf3526) protein while the immunogenic polypeptide still raises a substantially similar immune response in a subject as the *E. coli* AcfD (orf3526) protein.

Exemplary deletions that increase the solubility include removal of substantially all of the N-terminal amino acids up to the gly-ser region, removal of all or a part of the N-terminal proline-rich repeat, or both. The immunogenic polypeptide of claim 8, wherein the deletion is removal of at least the first 20 N-terminal amino acids as compared to the *E. coli* AcfD (orf3526) protein, at least the first 20 N-terminal amino acids as compared to the *E. coli* AcfD (orf3526) protein, at least the first 30 N-terminal amino acids as compared to the *E. coli* AcfD (orf3526) protein, at least the first 38 N-terminal amino acids as compared to the *E. coli* AcfD (orf3526) protein, at least the first 40 N-terminal amino acids as compared to the *E. coli* AcfD (orf3526) protein, at least the first 50 N-terminal amino acids as compared to the *E. coli* AcfD (orf3526) protein, at least the first 60 N-terminal amino acids as compared to the *E. coli* AcfD (orf3526) protein, at least the first 70 N-terminal amino acids as compared to the *E. coli* AcfD (orf3526) protein, at least the first 80 N-terminal amino acids as compared to the *E. coli* AcfD (orf3526) protein, at least the first 90 N-terminal amino acids as compared to the *E. coli* AcfD (orf3526) protein, or at least the first 94 N-terminal amino acids as compared to the *E. coli* AcfD (orf3526) protein.

The invention also provides an immunogenic polypeptide fragment of an *E. coli* AcfD (orf3526) polypeptide wherein the immunogenic polypeptide fragment comprises an amino acid sequence that comprises:
  (a) the amino acid sequence selected from the group consisting of SEQ ID NOs 77 to 95;
  (b) at least α% sequence identity to any one of SEQ ID NOs: 77 to 95; or
  (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or;
  (d) when aligned with any of SEQ ID NOs: 77 to 95 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer,
  wherein the immunogenic polypeptide fragment has lower toxicity than the *E. coli* AcfD (orf3526) protein and wherein the immunogenic polypeptide fragment raises a substantially similar immune response in a subject as the *E. coli* AcfD (orf3526) protein.

The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include other detoxified variants of SEQ ID NOs 77 to 95, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The immunogenic polypeptide fragment in certain embodiments will not comprise at least the first 10 N-terminal amino acids of the *E. coli* AcfD (orf3526) protein, at least the first 20 N-terminal amino acids of the *E. coli* AcfD (orf3526) protein, at least the first 25 N-terminal amino acids of the *E. coli* AcfD (orf3526) protein, at least the first 30 N-terminal amino acids of the *E. coli* AcfD (orf3526) protein, or at least the first 33 N-terminal amino acids of the *E. coli* AcfD (orf3526) protein.

The immunogenic polypeptide fragment in certain embodiments (which may be combined with the preceding embodiments) will not comprise at least the last 125 C-terminal amino acids of the *E. coli* AcfD (orf3526) protein, at least the last 150 C-terminal amino acids of the *E. coli* AcfD (orf3526) protein, at least the last 175 C-terminal amino acids of the *E. coli* AcfD (orf3526) protein, at least the last 200 C-terminal amino acids of the *E. coli* AcfD (orf3526) protein, at least the last 210 C-terminal amino acids of the *E. coli* AcfD (orf3526) protein, or at least the last 217 C-terminal amino acids of the *E. coli* AcfD (orf3526) protein.

The invention further provides an immunogenic polypeptide fragment comprising an *E. coli* AcfD (orf3526) polypeptide wherein the immunogenic polypeptide comprises an amino acid sequence that comprises:
  (a) the amino acid sequence selected from the group consisting of SEQ ID NOs 20 to 76;
  (b) at least α% sequence identity to any one of SEQ ID NOs: 20 to 76; or
  (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or;
  (d) when aligned with any of SEQ ID NOs: 20 to 76 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer,
  wherein the immunogenic polypeptide fragment raises a substantially similar immune response in a subject as the *E. coli* AcfD (orf3526) protein.

The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include other variants of SEQ ID NOs 20 to 76, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

Exemplary fragments will not comprise at least the last 100 C-terminal amino acids of the *E. coli* AcfD (orf3526) protein, at least the last 200 C-terminal amino acids of the *E. coli* AcfD (orf3526) protein, at least the last 300 C-terminal amino acids of the *E. coli* AcfD (orf3526) protein, at least the last 400 C-terminal amino acids of the *E. coli* AcfD (orf3526) protein, at least the last 500 C-terminal amino acids of the *E. coli* AcfD (orf3526) protein, at least the last 600 C-terminal amino acids of the *E. coli* AcfD (orf3526) protein, at least the last 700 C-terminal amino acids of the *E. coli* AcfD (orf3526) protein, at least the last 750 C-terminal amino acids of the *E. coli* AcfD (orf3526) protein, or at least the last 758 C-terminal amino acids of the *E. coli* AcfD (orf3526) protein or does not comprise at least the first 100 N-terminal amino acids of the *E. coli* AcfD (orf3526) protein, at least the first 200 N-terminal amino acids of the *E. coli* AcfD (orf3526) protein, at least the first 300 N-terminal amino acids of the *E. coli* AcfD (orf3526) protein, at least the first 400 N-terminal amino acids of the *E. coli* AcfD (orf3526) protein, at least the first 500 N-terminal amino acids of the *E. coli* AcfD (orf3526) protein, at least the first 600 N-terminal amino acids of the *E. coli* AcfD (orf3526) protein, at least the first 700 N-terminal amino acids of the *E. coli* AcfD (orf3526) protein, at least the first 750 N-terminal amino acids of the *E. coli* AcfD (orf3526) protein, or at least the first 760 N-terminal amino acids of the *E. coli* AcfD (orf3526) protein.

The foregoing immunogenic polypeptides may further contain a deletion relative to the *E. coli* AcfD (orf3526) protein which increases solubility of the immunogenic polypeptide as compared to the *E. coli* AcfD (orf3526) protein while the immunogenic polypeptide still raises a substantially similar immune response in a subject as the *E. coli* AcfD (orf3526) protein.

Exemplary deletions that increase the solubility include removal of substantially all of the N-terminal amino acids up to the gly-ser region, removal of all or a part of the N-terminal proline-rich repeat, or both. The immunogenic polypeptide of claim 8, wherein the deletion is removal of at least the first 20 N-terminal amino acids as compared to the *E. coli* AcfD (orf3526) protein, at least the first 20 N-terminal amino acids as compared to the *E. coli* AcfD (orf3526) protein, at least the first 30 N-terminal amino acids as compared to the *E. coli* AcfD (orf3526) protein, at least the first 38 N-terminal amino acids as compared to the *E. coli* AcfD (orf3526) protein, at least the first 40 N-terminal amino acids as compared to the *E. coli* AcfD (orf3526) protein, at least the first 50 N-terminal amino acids as compared to the *E. coli* AcfD (orf3526) protein, at least the first 60 N-terminal amino acids as compared to the *E. coli* AcfD (orf3526) protein, at least the first 70 N-terminal amino acids as compared to the *E. coli* AcfD (orf3526) protein, at least the first 80 N-terminal amino acids as compared to the *E. coli* AcfD (orf3526) protein, at least the first 90 N-terminal amino acids as compared to the *E. coli* AcfD (orf3526) protein, or at least the first 94 N-terminal amino acids as compared to the *E. coli* AcfD (orf3526) protein.

The *E. coli* AcfD (orf3526) protein may have an amino acid sequence selected from the group consisting of SEQ ID NOs: 1-19.

The invention also provides an immunogenic polypeptide fragment of an *E. coli* AcfD (orf3526) polypeptide wherein the immunogenic polypeptide fragment comprises an amino acid sequence that comprises:
  (a) the amino acid sequence selected from the group consisting of SEQ ID NOs 77 to 95;
  (b) at least α% sequence identity to any one of SEQ ID NOs: 77 to 95; or
  (c) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or;
  (d) when aligned with any of SEQ ID NOs: 77 to 95 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer, wherein the immunogenic polypeptide fragment raises a substantially similar immune response in a subject as the *E. coli* AcfD (orf3526) protein.

The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include other variants of SEQ ID NOs 77 to 95, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The immunogenic polypeptide fragment in certain embodiments will not comprise at least the first 10 N-terminal amino acids of the *E. coli* AcfD (orf3526) protein, at least the first 20 N-terminal amino acids of the *E. coli* AcfD (orf3526) protein, at least the first 25 N-terminal amino acids of the *E. coli* AcfD (orf3526) protein, at least the first 30 N-terminal amino acids of the *E. coli* AcfD (orf3526) protein, or at least the first 33 N-terminal amino acids of the *E. coli* AcfD (orf3526) protein.

The immunogenic polypeptide fragment in certain embodiments (which may be combined with the preceding embodiments) will not comprise at least the last 125 C-terminal amino acids of the *E. coli* AcfD (orf3526) protein, at least the last 150 C-terminal amino acids of the *E. coli* AcfD (orf3526) protein, at least the last 175 C-terminal amino acids of the *E. coli* AcfD (orf3526) protein, at least the last 200 C-terminal amino acids of the *E. coli* AcfD (orf3526) protein, at least the last 210 C-terminal amino acids of the *E. coli* AcfD (orf3526) protein, or at least the last 217 C-terminal amino acids of the *E. coli* AcfD (orf3526) protein.

The invention additionally provides an immunogenic composition that comprises an immunogenic polypeptide fragment of an *E. coli* AcfD (orf3526) polypeptide wherein the immunogenic polypeptide fragment comprises an amino acid sequence that comprises at least α% sequence identity to any one of SEQ ID NOs: 77 to 95, wherein the immunogenic polypeptide fragment raises a substantially similar immune response in a subject as the *E. coli* AcfD (orf3526) protein and wherein the immunogenic polypeptide fragment does not comprise at least the last 125 C-terminal amino acids of the *E. coli* AcfD (orf3526) protein, at least the last 150 C-terminal amino acids of the *E. coli* AcfD (orf3526) protein, at least the last 175 C-terminal amino acids of the *E. coli* AcfD (orf3526) protein, at least the last 200 C-terminal amino acids of the *E. coli* AcfD (orf3526) protein, at least the last 210 C-terminal amino acids of the *E. coli* AcfD (orf3526) protein, or at least the last 217 C-terminal amino acids of the *E. coli* AcfD (orf3526) protein.

The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include other variants of SEQ ID NOs 77 to 95, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The immunogenic polypeptide fragment of the immunogenic composition in certain embodiments will not comprise at least the first 10 N-terminal amino acids of the *E. coli* AcfD (orf3526) protein, at least the first 20 N-terminal amino acids of the *E. coli* AcfD (orf3526) protein, at least the first 25 N-terminal amino acids of the *E. coli* AcfD (orf3526) protein, at least the first 30 N-terminal amino acids of the *E. coli* AcfD (orf3526) protein, or at least the first 33 N-terminal amino acids of the *E. coli* AcfD (orf3526) protein.

The immunogenic composition may further comprise an adjuvant which may in certain embodiments comprise 1-12% by volume of a metabolizable oil, and 0.2% to 2.5% by weight of an emulsifying agent, wherein the metabolizable oil and the emulsifying agent are present in the form of an oil-in-water emulsion having oil droplets substantially all of which are less than 1 micron in diameter; 4-5% by volume of squalene, and (b) about 1% of an emulsifying agent comprising polyoxyethylenesorbitan monooleate and sorbitan trioleate, wherein the squalene and the emulsifying agent are present in the form of an oil-in-water emulsion having oil droplets substantially all of which are less than 1 micron in diameter; or MF59 (TM).

The foregoing detoxified immunogenic polypeptides and immunogenic polypeptide fragments preferably retain at least one epitope or immunogenic fragment of SEQ ID NOs 1 to 19. An epitope within a fragment may be a B-cell epitope and/or a T-cell epitope. Such epitopes can be identified empirically (e.g. using PEPSCAN [9,10] or similar methods), or they can be predicted (e.g. using the Jameson-Wolf antigenic index [11], matrix-based approaches [12], MAPITOPE [13], TEPITOPE [14,15], neural networks [16], OptiMer & EpiMer [17, 18], ADEPT [19], Tsites [20], hydrophilicity [21], antigenic index [22] or the methods disclosed in references 23-27, etc.). Epitopes are the parts of an antigen that are recognised by and bind to the antigen binding sites of antibodies or T-cell receptors, and they may also be referred to as "antigenic determinants".

The foregoing detoxified immunogenic polypeptides and immunogenic polypeptide fragments include, without limitation, immunogenic polypeptides that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 1 to 19, respectively, from which the immunogenic polypeptide is derived.

The foregoing detoxified immunogenic polypeptides and immunogenic polypeptide fragments include, without limitation, immunogenic polypeptides that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 1 to 19, respectively, from which the immunogenic fragment is derived.

The foregoing detoxified immunogenic polypeptides and immunogenic polypeptide fragments include, without limitation, immunogenic polypeptides that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 1 to 19, respectively, from which the immunogenic fragment is derived.

A detoxified polypeptide of the invention may, compared to any one of SEQ ID NOs 1 to 19, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity.

A detoxified polypeptide may include one or more (e.g. 1, 2, 3, 4, 5, 6, 7, 8, 9, etc.) single amino acid deletions relative to any one of SEQ ID NOs 1 to 19. Similarly, a polypeptides may include one or more (e.g. 1, 2, 3, 4, 5, 6, 7, 8, 9, etc.) insertions (e.g. each of 1, 2, 3, 4 or 5 amino acids) relative to any one of SEQ ID NOs 1 to 19.

In general, when a detoxified polypeptide or immunogenic polypeptide fragment of the invention comprises a sequence that is not identical to a complete one of SEQ ID NOs 1 to 19 (e.g. when it comprises a sequence listing with <100% sequence identity thereto, or when it comprises a fragment thereof) it is preferred that the polypeptide can elicit an antibody that recognises a polypeptide consisting of the complete SEQ ID sequence i.e. the antibody binds to one or more of said SEQ ID NOs 1 to 19. Such antibody may bind specifically to SEQ ID NOs 1 to 19, respectively while not binding to non-AcfD (orf3526) proteins with affinity significantly higher than the antibody's non-specific affinity to human serum albumin as a non-specific binding reference standard.

Polypeptides used with the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.). For instance, a polypeptide of the invention may have a lipidated N-terminal cysteine (e.g. Cys-24 of SEQ ID NOs: 1 to 19).

Polypeptides used with the invention can be prepared by various means (e.g. recombinant expression, purification from cell culture, chemical synthesis, etc.). Recombinantly-expressed proteins are preferred.

Polypeptides used with the invention are preferably provided in purified or substantially purified form i.e. substantially free from other polypeptides (e.g. free from naturally-occurring polypeptides), particularly from other E. coli or host cell polypeptides, and are generally at least about 50% pure (by weight), and usually at least about 90% pure i.e. less than about 50%, and more preferably less than about 10% (e.g. 5%) of a composition is made up of other expressed polypeptides. Thus the antigens in the compositions are separated from the whole organism with which the molecule is expressed.

Polypeptides used with the invention are preferably E. coli polypeptides. Such polypeptides may be further selected from NMEC, APEC, UPEC, EAEC, EIEC, EPEC and ETEC E. coli polypeptides.

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included are, for example, polypeptides containing one or more analogs of an amino acid (including, for example, unnatural amino acids, etc.), as well as other modifications known in the art. Polypeptides can occur as single chains or associated chains.

The invention provides polypeptides comprising a sequence -P-Q- or -Q-P-, wherein: -P- is an amino acid sequence as defined above and -Q- is not a sequence as defined above i.e. the invention provides fusion proteins. Where the N-terminus codon of -P- is not ATG, but this codon is not present at the N-terminus of a polypeptide, it will be translated as the standard amino acid for that codon rather than as a Met. Where this codon is at the N-terminus of a polypeptide, however, it will be translated as Met. Examples of -Q- moieties include, but are not limited to, histidine tags (i.e. $His_n$ where n=3, 4, 5, 6, 7, 8, 9, 10 or more), a maltose-binding protein, or glutathione-S-transferase (GST).

The invention also provides an oligomeric protein comprising a polypeptide of the invention. The oligomer may be a dimer, a trimer, a tetramer, etc. The oligomer may be a homo-oligomer or a hetero-oligomer. Polypeptides in the oligomer may be covalently or non-covalently associated.

Comparison of the immune response raised in a subject by the polypeptide with the immune response raised by the full length protein may be carried out use by any means available to one of skill in the art. One simple method as used in the examples below involves immunization of a model subject such as mouse and then challenge with a lethal dose of E. coli. For proper comparison, one of skill in the art would naturally select the same adjuvant such as Freund's complete adjuvant. In such a test the immunogenic polypeptide fragments of the present invention will raise a substantially similar immune response in a subject (i.e., will provide substantially the same protection against the lethal challenge) if, for example, the polypeptide provides at least 70% of the protection provided by the full length protein, at least 80% of the protection provided by the full length protein, at least 85% of the protection provided by the full length protein, at least 90% of the protection provided by the full length protein, at least 95% of the protection provided by the full length protein, at least 97% of the protection provided by the full length protein, at least 98% of the protection provided by the full length protein, or at least 99% of the protection provided by the full length protein.

The full length AcfD (orf3526) protein against which the immunogenic polypeptide fragment would be compared (for solubility, toxicity and immune response raised) may be any representative E. coli AcfD (orf3526) protein including without limitation SEQ ID NOs 1-19. In preferred embodiments, the AcfD (orf3526) protein will be the corresponding full length protein from which the immunogenic polypeptide fragment is obtained.

The invention also provides a process for producing a polypeptide of the invention, comprising the step of culturing a host cell transformed with nucleic acid of the invention under conditions which induce polypeptide expression. The polypeptide may then be purified e.g. from culture supernatants.

The invention provides an *E. coli* cell, containing a plasmid that encodes a polypeptide of the invention. The chromosome of the *E. coli* cell may include a homolog of AcfD (orf3526), or such a homolog may be absent, but in both cases the polypeptide of the invention can be expressed from the plasmid. The plasmid may include a gene encoding a marker, etc. These and other details of suitable plasmids are given below.

Although expression of the polypeptides of the invention may take place in an *E. coli* strain, the invention will usually use a heterologous host for expression. The heterologous host may be prokaryotic (e.g. a bacterium) or eukaryotic. Suitable hosts include, but are not limited to, *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc.

The invention provides a process for producing a polypeptide of the invention, comprising the step of synthesising at least part of the polypeptide by chemical means.

Any and all of the foregoing proteins, polypeptides, hybrid polypeptides, epitopes and immunogenic fragments may be in any one of a number of forms including, without limitation, recombinant, isolated or substantially purified (from materials co-existing with such proteins, polypeptides, hybrid polypeptides, epitopes and immunogenic fragments in their natural state).

Nucleic Acids

The invention also provides nucleic acid encoding polypeptides and hybrid polypeptides of the invention. It also provides nucleic acid comprising a nucleotide sequence that encodes one or more polypeptides or hybrid polypeptides of the invention.

The invention also provides nucleic acid comprising nucleotide sequences having sequence identity to such nucleotide sequences. Identity between sequences is preferably determined by the Smith-Waterman homology search algorithm as described above. Such nucleic acids include those using alternative codons to encode the same amino acid.

The invention also provides nucleic acid which can hybridize to these nucleic acids. Hybridization reactions can be performed under conditions of different "stringency". Conditions that increase stringency of a hybridization reaction of widely known and published in the art (e.g. page 7.52 of reference 211). Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art (e.g. see refs 28, 29, 211, 213, etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

The invention includes nucleic acid comprising sequences complementary to these sequences (e.g. for antisense or probing, or for use as primers).

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other *E. coli* or host cell nucleic acids, generally being at least about 50% pure (by weight), and usually at least about 90% pure. Nucleic acids of the invention are preferably *E. coli* nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids, as mentioned above. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Immunogenic Compositions and Medicaments

Polypeptides of the invention are useful as active ingredients (immunogens) in immunogenic compositions, and such compositions may be useful as vaccines. Vaccines according to the invention may either be prophylactic (i.e. to prevent infection) or therapeutic (i.e. to treat infection), but will typically be prophylactic.

Immunogenic compositions will be pharmaceutically acceptable. They will usually include components in addition to the antigens e.g. they typically include one or more pharmaceutical carrier(s), excipient(s) and/or adjuvant(s). A thorough discussion of carriers and excipients is available in ref. 208. Thorough discussions of vaccine adjuvants are available in refs. 30 and 31.

Compositions will generally be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 μg/ml) mercurial material e.g. thiomersal-free. Vaccines containing no mercury are more preferred. Preservative-free vaccines are particularly preferred.

To improve thermal stability, a composition may include a temperature protective agent.

To control tonicity, it is preferred to include a physiological salt, such as a sodium salt. Sodium chloride (NaCl) is preferred, which may be present at between 1 and 20 mg/ml e.g. about 10±2 mg/ml NaCl. Other salts that may be present include potassium chloride, potassium dihydrogen phosphate, disodium phosphate dehydrate, magnesium chloride, calcium chloride, etc.

Compositions will generally have an osmolality of between 200 mOsm/kg and 400 mOsm/kg, preferably between 240-360 mOsm/kg, and will more preferably fall within the range of 290-310 mOsm/kg.

Compositions may include one or more buffers. Typical buffers include: a phosphate buffer; a Tris buffer; a borate buffer; a succinate buffer; a histidine buffer (particularly with an aluminum hydroxide adjuvant); or a citrate buffer. Buffers will typically be included in the 5-20 mM range.

The pH of a composition will generally be between 5.0 and 8.1, and more typically between 6.0 and 8.0 e.g. 6.5 and 7.5, or between 7.0 and 7.8.

The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material.

Human vaccines are typically administered in a dosage volume of about 0.5 ml, although a half dose (i.e. about 0.25 ml) may be administered to children.

Immunogenic compositions of the invention may also comprise one or more immunoregulatory agents. Preferably, one or more of the immunoregulatory agents include one or more adjuvants. The adjuvants may include a TH1 adjuvant and/or a TH2 adjuvant, further discussed below.

Adjuvants which may be used in compositions of the invention include, but are not limited to:

A. Mineral-Containing Compositions

Mineral containing compositions suitable for use as adjuvants in the invention include mineral salts, such as aluminium salts and calcium salts (or mixtures thereof). Calcium salts include calcium phosphate (e.g. the "CAP" particles disclosed in ref. 32). Aluminum salts include hydroxides, phosphates, sulfates, etc., with the salts taking any suitable form (e.g. gel, crystalline, amorphous, etc.). Adsorption to these salts is preferred. The mineral containing compositions may also be formulated as a particle of metal salt [33].

The adjuvants known as aluminum hydroxide and aluminum phosphate may be used. These names are conventional, but are used for convenience only, as neither is a precise description of the actual chemical compound which is present (e.g. see chapter 9 of reference 30). The invention can use any of the "hydroxide" or "phosphate" adjuvants that are in general use as adjuvants. The adjuvants known as "aluminium hydroxide" are typically aluminium oxyhydroxide salts, which are usually at least partially crystalline. The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt.

A fibrous morphology (e.g. as seen in transmission electron micrographs) is typical for aluminium hydroxide adjuvants. The pI of aluminium hydroxide adjuvants is typically about 11 i.e. the adjuvant itself has a positive surface charge at physiological pH. Adsorptive capacities of between 1.8-2.6 mg protein per mg $Al^{+++}$ at pH 7.4 have been reported for aluminium hydroxide adjuvants.

Aluminium phosphate adjuvants generally have a $PO_4/Al$ molar ratio between 0.3 and 1.2, preferably between 0.8 and 1.2, and more preferably 0.95±0.1. The aluminium phosphate will generally be amorphous, particularly for hydroxyphosphate salts. A typical adjuvant is amorphous aluminium hydroxyphosphate with $PO_4/Al$ molar ratio between 0.84 and 0.92, included at 0.6 mg $Al^{3+}$/ml. The aluminium phosphate will generally be particulate (e.g. plate-like morphology as seen in transmission electron micrographs). Typical diameters of the particles are in the range 0.5-20 μm (e.g. about 5-10 μm) after any antigen adsorption. Adsorptive capacities of between 0.7-1.5 mg protein per mg $Al^{+++}$ at pH 7.4 have been reported for aluminium phosphate adjuvants.

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

The invention can use a mixture of both an aluminium hydroxide and an aluminium phosphate. In this case there may be more aluminium phosphate than hydroxide e.g. a weight ratio of at least 2:1 e.g. ≥5:1, ≥6:1, ≥7:1, ≥8:1, ≥9:1, etc.

The concentration of $Al^{+++}$ in a composition for administration to a patient is preferably less than 10 mg/ml e.g. ≤5 mg/ml, ≤4 mg/ml, ≤3 mg/ml, ≤2 mg/ml, ≤1 mg/ml, etc. A preferred range is between 0.3 and 1 mg/ml. A maximum of 0.85 mg/dose is preferred.

B. Oil Emulsions

Oil emulsion compositions suitable for use as adjuvants in the invention include squalene-water emulsions, such as MF59 [Chapter 10 of ref. 30; see also ref. 34] (5% Squalene, 0.5% Tween 80, and 0.5% Span 85, formulated into submicron particles using a microfluidizer). Complete Freund's adjuvant (CFA) and incomplete Freund's adjuvant (IFA) may also be used.

Various oil-in-water emulsion adjuvants are known, and they typically include at least one oil and at least one surfactant, with the oil(s) and surfactant(s) being biodegradable (metabolisable) and biocompatible. The oil droplets in the emulsion are generally less than 5 μm in diameter, and ideally have a sub-micron diameter, with these small sizes being achieved with a microfluidiser to provide stable emulsions. Droplets with a size less than 220 nm are preferred as they can be subjected to filter sterilization.

The emulsion can comprise oils such as those from an animal (such as fish) or vegetable source. Sources for vegetable oils include nuts, seeds and grains. Peanut oil, soybean oil, coconut oil, and olive oil, the most commonly available, exemplify the nut oils. Jojoba oil can be used e.g. obtained from the jojoba bean. Seed oils include safflower oil, cottonseed oil, sunflower seed oil, sesame seed oil and the like. In the grain group, corn oil is the most readily available, but the oil of other cereal grains such as wheat, oats, rye, rice, teff, triticale and the like may also be used. 6-10 carbon fatty acid esters of glycerol and 1,2-propanediol, while not occurring naturally in seed oils, may be prepared by hydrolysis, separation and esterification of the appropriate materials starting from the nut and seed oils. Fats and oils from mammalian milk are metabolizable and may therefore be used in the practice of this invention. The procedures for separation, purification, saponification and other means necessary for obtaining pure oils from animal sources are well known in the art. Most fish contain metabolizable oils which may be readily recovered. For example, cod liver oil, shark liver oils, and whale oil such as spermaceti exemplify several of the fish oils which may be used herein. A number of branched chain oils are synthesized biochemically in 5-carbon isoprene units and are generally referred to as terpenoids. Shark liver oil contains a branched, unsaturated terpenoids known as squalene, 2,6,10,15,19,23-hexamethyl-2,6,10,14,18,22-tetracosahexaene, which is particularly preferred herein. Squalane, the saturated analog to squalene, is also a preferred oil. Fish oils, including squalene and squalane, are readily available from commercial sources or may be obtained by methods known in the art. Other preferred oils are the tocopherols (see below). Mixtures of oils can be used.

Surfactants can be classified by their 'HLB' (hydrophile/lipophile balance). Preferred surfactants of the invention have a HLB of at least 10, preferably at least 15, and more preferably at least 16. The invention can be used with surfactants including, but not limited to: the polyoxyethylene sorbitan esters surfactants (commonly referred to as the Tweens), especially polysorbate 20 and polysorbate 80; copolymers of ethylene oxide (EO), propylene oxide (PO), and/or butylene oxide (BO), sold under the DOWFAX™ tradename, such as linear EO/PO block copolymers; octoxynols, which can vary in the number of repeating ethoxy (oxy-1,2-ethanediyl) groups, with octoxynol-9 (Triton X-100, or t-octylphenoxypolyethoxyethanol) being of particular interest; (octylphenoxy)polyethoxyethanol (IGEPAL CA-630/NP-40); phospholipids such as phosphatidylcholine (lecithin); nonylphenol ethoxylates, such as the Tergitol™ NP series; polyoxyethylene fatty ethers derived from lauryl, cetyl, stearyl and oleyl alcohols (known as Brij surfactants), such as triethyleneglycol monolauryl ether (Brij 30); and sorbitan esters (commonly known as the SPANs), such as sorbitan trioleate (Span 85) and sorbitan monolaurate. Non-ionic surfactants are preferred. Preferred surfactants for including in the emulsion are Tween 80 (polyoxyethylene sorbitan monooleate), Span 85 (sorbitan trioleate), lecithin and Triton X-100.

Mixtures of surfactants can be used e.g. Tween 80/Span 85 mixtures. A combination of a polyoxyethylene sorbitan ester such as polyoxyethylene sorbitan monooleate (Tween 80) and an octoxynol such as t-octylphenoxypolyethoxyethanol (Triton X-100) is also suitable. Another useful combination comprises laureth 9 plus a polyoxyethylene sorbitan ester and/or an octoxynol.

Preferred amounts of surfactants (% by weight) are: polyoxyethylene sorbitan esters (such as Tween 80) 0.01 to 1%, in particular about 0.1%; octyl- or nonylphenoxy polyoxyethanols (such as Triton X-100, or other detergents in the Triton series) 0.001 to 0.1%, in particular 0.005 to 0.02%; polyoxyethylene ethers (such as laureth 9) 0.1 to 20%, preferably 0.1 to 10% and in particular 0.1 to 1% or about 0.5%.

Preferred emulsion adjuvants have an average droplets size of <1 μm e.g. ≤750 nm, ≤500 nm, ≤400 nm, ≤300 nm, ≤250 nm, ≤220 nm, >200 nm, or smaller. These droplet sizes can conveniently be achieved by techniques such as microfluidisation.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% Span 85. In weight terms, these ratios become 4.3% squalene, 0.5% polysorbate 80 and 0.48% Span 85. This adjuvant is known as 'MF59' [35-37], as described in more detail in Chapter 10 of ref. 38 and chapter 12 of ref 39. The MF59 emulsion advantageously includes citrate ions e.g. 10 mM sodium citrate buffer.

An emulsion of squalene, a tocopherol, and Tween 80. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≤1 as this provides a more stable emulsion. Squalene and Tween 80 may be present volume ratio of about 5:2. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100). The emulsion may also include a 3d-MPL (see below). The emulsion may contain a phosphate buffer.

An emulsion comprising a polysorbate (e.g. polysorbate 80), a Triton detergent (e.g. Triton X-100) and a tocopherol (e.g. an α-tocopherol succinate). The emulsion may include these three components at a mass ratio of about 75:11:10 (e.g. 750 μg/ml polysorbate 80, 110 μg/ml Triton X-100 and 100 μg/ml α-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("Pluronic™ L121"). The emulsion can be formulated in phosphate buffered saline, pH 7.4. This emulsion is a useful delivery vehicle for muramyl dipeptides, and has been used with threonyl-MDP in the "SAF-1" adjuvant [40] (0.05-1% Thr-MDP, 5% squalane, 2.5% Pluronic™ L121 and 0.2% polysorbate 80). It can also be used without the Thr-MDP, as in the "AF" adjuvant [41] (5% squalane, 1.25% Pluronic L121 and 0.2% polysorbate 80). Microfluidisation is preferred.

An emulsion comprising squalene, an aqueous solvent, a polyoxyethylene alkyl ether hydrophilic nonionic surfactant (e.g. polyoxyethylene (12) cetostearyl ether) and a hydrophobic nonionic surfactant (e.g. a sorbitan ester or mannide ester, such as sorbitan monoleate or 'Span 80'). The emulsion is preferably thermoreversible and/or has at least 90% of the oil droplets (by volume) with a size less than 200 nm [42]. The emulsion may also include one or more of: alditol; a cryoprotective agent (e.g. a sugar, such as dodecylmaltoside and/or sucrose); and/or an alkylpolyglycoside. Such emulsions may be lyophilized.

An emulsion of squalene, poloxamer 105 and Abil-Care [43]. The final concentration (weight) of these components in adjuvanted vaccines are 5% squalene, 4% poloxamer 105 (pluronic polyol) and 2% Abil-Care 85 (Bis-PEG/PPG-16/16 PEG/PPG-16/16 dimethicone; caprylic/capric triglyceride).

An emulsion having from 0.5-50% of an oil, 0.1-10% of a phospholipid, and 0.05-5% of a non-ionic surfactant. As described in reference 44, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, Tween 80 or Span 80). Additives may be included, such as QuilA saponin, cholesterol, a saponin-lipophile conjugate (such as GPI-0100, described in reference 45, produced by addition of aliphatic amine to desacylsaponin via the carboxyl group of glucuronic acid), dimethyldioctadecylammonium bromide and/or N,N-dioctadecyl-N,N-bis(2-hydroxyethyl)propanediamine.

An emulsion in which a saponin (e.g. QuilA or QS21) and a sterol (e.g. a cholesterol) are associated as helical micelles [46].

An emulsion comprising a mineral oil, a non-ionic lipophilic ethoxylated fatty alcohol, and a non-ionic hydrophilic surfactant (e.g. an ethoxylated fatty alcohol and/or polyoxyethylene-polyoxypropylene block copolymer) [47].

An emulsion comprising a mineral oil, a non-ionic hydrophilic ethoxylated fatty alcohol, and a non-ionic lipophilic surfactant (e.g. an ethoxylated fatty alcohol and/or polyoxyethylene-polyoxypropylene block copolymer) [47].

In some embodiments an emulsion may be mixed with antigen extemporaneously, at the time of delivery, and thus the adjuvant and antigen may be kept separately in a packaged or distributed vaccine, ready for final formulation at the time of use. In other embodiments an emulsion is mixed with antigen during manufacture, and thus the composition is packaged in a liquid adjuvanted form. The antigen will generally be in an aqueous form, such that the vaccine is finally prepared by mixing two liquids. The volume ratio of the two liquids for mixing can vary (e.g. between 5:1 and 1:5) but is generally about 1:1. Where concentrations of components are given in the above descriptions of specific emulsions, these concentrations are typically for an undiluted composition, and the concentration after mixing with an antigen solution will thus decrease.

Where a composition includes a tocopherol, any of the α, β, γ, δ, ε or ξ tocopherols can be used, but α-tocopherols are preferred. The tocopherol can take several forms e.g. different salts and/or isomers. Salts include organic salts, such as succinate, acetate, nicotinate, etc. D-α-tocopherol and DL-α-tocopherol can both be used. Tocopherols are advantageously included in vaccines for use in elderly patients (e.g. aged 60 years or older) because vitamin E has been reported to have a positive effect on the immune response in this patient group [48]. They also have antioxidant properties that may help to stabilize the emulsions [49]. A preferred α-tocopherol is DL-α-tocopherol, and the preferred salt of this tocopherol is the succinate. The succinate salt has been found to cooperate with TNF-related ligands in vivo.

C. Saponin Formulations [Chapter 22 of Ref. 30]

Saponin formulations may also be used as adjuvants in the invention. Saponins are a heterogeneous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 50. Saponin formulations may also comprise a sterol, such as cholesterol [51].

Combinations of saponins and cholesterols can be used to form unique particles called immunostimulating complexes (ISCOMs) [chapter 23 of ref. 30]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 51-53. Optionally, the ISCOMS may be devoid of additional detergent [54].

A review of the development of saponin based adjuvants can be found in refs. 55 & 56.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 57-62. Virosomes are discussed further in, for example, ref. 63

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 64. Such "small particles" of 3dMPL are small enough to be sterile filtered through a 0.22 μm membrane [64]. Other non-toxic LPS derivatives include monophosphoryl lipid A mimics, such as aminoalkyl glucosaminide phosphate derivatives e.g. RC-529 [65,66].

Lipid A derivatives include derivatives of lipid A from *Escherichia coli* such as OM-174. OM-174 is described for example in refs. 67 & 68.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 69, 70 and 71 disclose possible analog substitutions e.g. replacement of guanosine with 2'-deoxy-7-deazaguanosine. The adjuvant effect of CpG oligonucleotides is further discussed in refs. 72-77.

The CpG sequence may be directed to TLR9, such as the motif GTCGTT or TTCGTT [78]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 79-81. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 78 & 82-84.

A useful CpG adjuvant is CpG7909, also known as Pro-Mune™ (Coley Pharmaceutical Group, Inc.). Another is CpG1826. As an alternative, or in addition, to using CpG sequences, TpG sequences can be used [85], and these oligonucleotides may be free from unmethylated CpG motifs. The immunostimulatory oligonucleotide may be pyrimidine-rich. For example, it may comprise more than one consecutive thymidine nucleotide (e.g. TTTT, as disclosed in ref. 85), and/or it may have a nucleotide composition with >25% thymidine (e.g. >35%, >40%, >50%, >60%, >80%, etc.). For example, it may comprise more than one consecutive cytosine nucleotide (e.g. CCCC, as disclosed in ref. 85), and/or it may have a nucleotide composition with >25% cytosine (e.g. >35%, >40%, >50%, >60%, >80%, etc.). These oligonucleotides may be free from unmethylated CpG motifs. Immunostimulatory oligonucleotides will typically comprise at least 20 nucleotides. They may comprise fewer than 100 nucleotides.

A particularly useful adjuvant based around immunostimulatory oligonucleotides is known as IC-31™ [86]. Thus an adjuvant used with the invention may comprise a mixture of (i) an oligonucleotide (e.g. between 15-40 nucleotides) including at least one (and preferably multiple) CpI motifs (i.e. a cytosine linked to an inosine to form a dinucleotide), and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO: 110). The polycationic polymer may be a peptide comprising 11-mer amino acid sequence KLKLLLLLKLK (SEQ ID NO: 111).

Bacterial ADP-ribosylating toxins and detoxified derivatives thereof may be used as adjuvants in the invention. Preferably, the protein is derived from E. coli (E. coli heat labile enterotoxin "LT"), cholera ("CT"), or pertussis ("PT"). The use of detoxified ADP-ribosylating toxins as mucosal adjuvants is described in ref. 87 and as parenteral adjuvants in ref. 88. The toxin or toxoid is preferably in the form of a holo-toxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 89-96. A useful CT mutant is or CT-E29H [97]. Numerical reference for amino acid substitutions is preferably based on the alignments of the A and B subunits of ADP-ribosylating toxins set forth in ref. 98, specifically incorporated herein by reference in its entirety solely for the purpose of the alignment and amino acid numbering therein.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [99], etc.) [100], interferons (e.g. interferon-γ), macrophage colony stimulating factor, and tumor necrosis factor. A preferred immunomodulator is IL-12.

G. Bioadhesives and Mucoadhesives

Bioadhesives and mucoadhesives may also be used as adjuvants in the invention. Suitable bioadhesives include esterified hyaluronic acid microspheres [101] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [102].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref. 30)

Examples of liposome formulations suitable for use as adjuvants are described in refs. 103-105.

J. Polyoxyethylene Ether and Polyoxyethylene Ester Formulations

Adjuvants suitable for use in the invention include polyoxyethylene ethers and polyoxyethylene esters [106]. Such formulations further include polyoxyethylene sorbitan ester surfactants in combination with an octoxynol [107] as well as polyoxyethylene alkyl ethers or ester surfactants in combination with at least one additional non-ionic surfactant such as an octoxynol [108]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Phosphazenes

A phosphazene, such as poly[di(carboxylatophenoxy) phosphazene] ("PCPP") as described, for example, in references 109 and 110, may be used.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinolone Compounds.

Examples of imidazoquinolone compounds suitable for use adjuvants in the invention include Imiquimod ("R-837") [111,112], Resiquimod ("R-848") [113], and their analogs; and salts thereof (e.g. the hydrochloride salts). Further details about immunostimulatory imidazoquinolines can be found in references 114 to 118.

N. Substituted Ureas

Substituted ureas useful as adjuvants include compounds of formula I, II or III, or salts thereof:

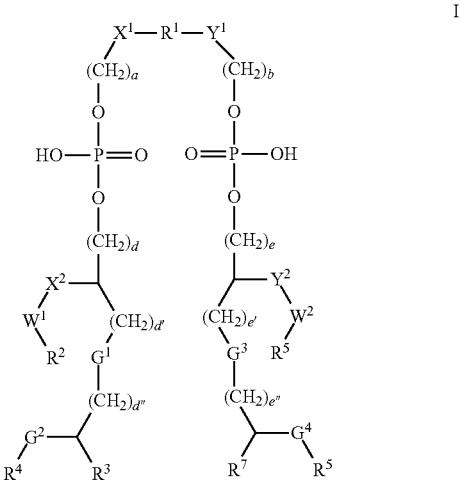

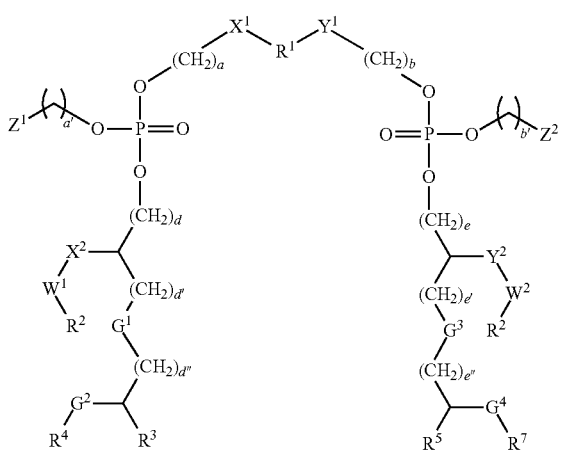

-continued

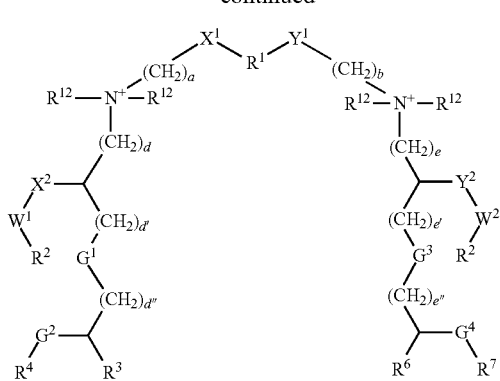

as defined in reference 119, such as 'ER 803058', 'ER 803732', 'ER 804053', ER 804058', 'ER 804059', 'ER 804442', 'ER 804680', 'ER 804764', ER 803022 or 'ER 804057' e.g.:

O. Further Adjuvants

Further adjuvants that may be used with the invention include:

An aminoalkyl glucosaminide phosphate derivative, such as RC-529 [120,121].

A thiosemicarbazone compound, such as those disclosed in reference 122. Methods of formulating, manufacturing, and screening for active compounds are also described in reference 122. The thiosemicarbazones are particularly effective in the stimulation of human peripheral blood mononuclear cells for the production of cytokines, such as TNF-α.

A tryptanthrin compound, such as those disclosed in reference 123. Methods of formulating, manufacturing, and screening for active compounds are also described in reference 123. The thiosemicarbazones are particularly effective in the stimulation of human peripheral blood mononuclear cells for the production of cytokines, such as TNF-α.

A nucleoside analog, such as: (a) Isatorabine (ANA-245; 7-thia-8-oxoguanosine):

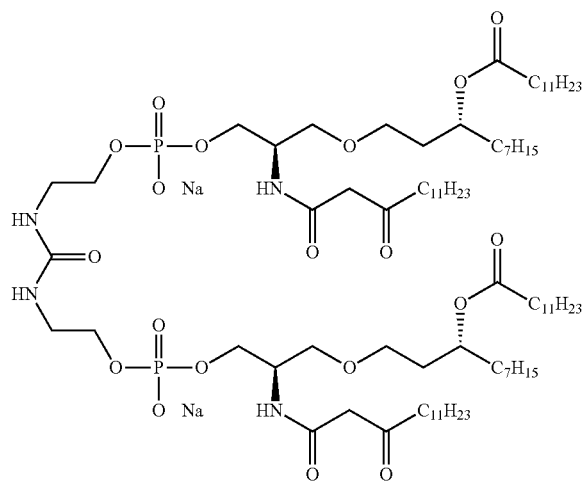

ER804057

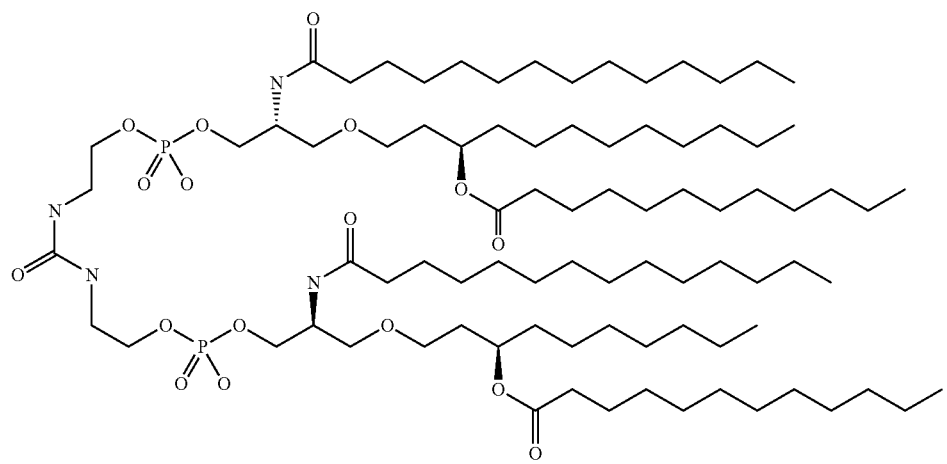

ER-803022

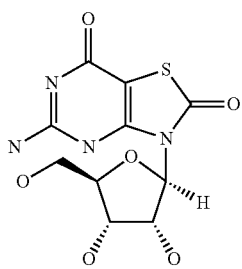 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 124 to 126Loxoribine (7-allyl-8-oxoguanosine) [127].

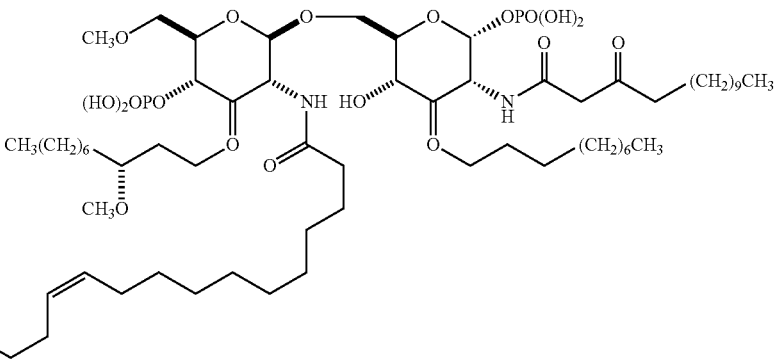

Compounds disclosed in reference 128, including:
Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [129,130], Hydrapthalamide compounds, Benzophenone compounds, Isoxazole compounds, Sterol compounds, Quinazilinone compounds, Pyrrole compounds [131], Anthraquinone compounds, Quinoxaline compounds, Triazine compounds, Pyrazalopyrimidine compounds, and Benzazole compounds [132].

Compounds containing lipids linked to a phosphate-containing acyclic backbone, such as the TLR4 antagonist E5564 [133,134]:

A polyoxidonium polymer [135,136] or other N-oxidized polyethylene-piperazine derivative.

Methyl inosine 5'-monophosphate ("MIMP") [137].

A polyhydroxlated pyrrolizidine compound [138], such as one having formula:

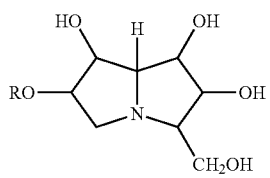

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.

A CD1d ligand, such as an α-glycosylceramide [139-146] (e.g. α-galactosylceramide), phytosphingosine-containing α-glycosylceramides, OCH, KRN7000 [(2S,3S,4R)-1-O-(α-D-galactopyranosyl)-2-(N-hexacosanoylamino)-1,3,4-octadecanetriol], CRONY-101, 3"-O-sulfo-galactosylceramide, etc.

A gamma inulin [147] or derivative thereof, such as algammulin.

Adjuvant Combinations

The invention may also comprise combinations of aspects of one or more of the adjuvants identified above. For example, the following adjuvant compositions may be used in the invention: (1) a saponin and an oil-in-water emulsion [148]; (2) a saponin (e.g. QS21)+a non-toxic LPS derivative (e.g. 3dMPL) [149]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [150]; (5) combinations of 3dMPL with, for example, QS21 and/or oil-in-water emulsions [151]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of ref. 30.

The use of an aluminium hydroxide and/or aluminium phosphate adjuvant is particularly preferred, and antigens are generally adsorbed to these salts. Calcium phosphate is another preferred adjuvant. Other preferred adjuvant combinations include combinations of Th1 and Th2 adjuvants such as CpG & alum or resiquimod & alum. A combination of aluminium phosphate and 3dMPL may be used.

The compositions of the invention may elicit both a cell mediated immune response as well as a humoral immune response. This immune response will preferably induce long lasting (e.g. neutralising) antibodies and a cell mediated immunity that can quickly respond upon exposure to pnuemococcus.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH 1 immune response and a TH2 immune response.

A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH 1 adjuvants for use in the invention.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response, i.e., an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

*E. coli* can cause disease at a number of anatomical locations [4] and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials.

Methods of Treatment, and Administration of the Vaccine

The invention also provides a method for raising an immune response in a mammal comprising the step of administering an effective amount of a composition of the invention. The immune response is preferably protective and preferably involves antibodies and/or cell-mediated immunity. The method may raise a booster response.

The invention also provides a polypeptide of the invention for use as a medicament e.g. for use in raising an immune response in a mammal.

The invention also provides the use of a polypeptide of the invention in the manufacture of a medicament for raising an immune response in a mammal.

The invention also provides a delivery device pre-filled with an immunogenic composition of the invention.

By raising an immune response in the mammal by these uses and methods, the mammal can be protected against *E. coli* infection, including ExPEC and non-ExPEC strains. The invention is particularly useful for providing broad protection against pathogenic *E. coli*, including intestinal pathotypes such as EPEC, EAEC, EIEC, ETEC and DAEC pathotypes. Thus the mammal may be protected against diseases including, but not limited to peritonitis, pyelonephritis, cystitis, endocarditis, prostatitis, urinary tract infections (UTIs), meningitis (particularly neonatal meningitis), sepsis (or SIRS), dehydration, pneumonia, diarrhea (infantile, travellers', acute, persistent, etc.), bacillary dysentery, hemolytic uremic syndrome (HUS), pericarditis, bacteriuria, etc.

SEQ ID NO: 21, 30, 35, 40, 49, 54, 59, 68, and 73 and their other detoxified variants are particularly useful for immunising against the EAEC pathotype, and thus for preventing diarrhea (both acute and chronic).

SEQ ID NO: 22, 28, 36, 41, 47, 55, 56, 60, 66, 74, and 75 and their other detoxified variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 23, 42, and 61 and their other detoxified variants are particularly useful for immunising against the EIEC pathotype, and thus for preventing dysentery (in particular bacillary dysentery) and HUS (e.g. in children).

SEQ ID NO: 24, 27, 29, 43, 46, 48, 62, 65, and 67 and their other detoxified variants are particularly useful for immunising against the ETEC pathotype, and thus for preventing diarrhea (including travellers' and infant diarrhea).

SEQ ID NO: 25, 26, 33, 34, 45, 53, 63, 64, and 72 and their other detoxified variants are particularly useful for immunising against the EAEC pathotype, and thus for preventing diarrhea (both acute and chronic).

SEQ ID NO: 79, 85, 93, and 94 and their other detoxified variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 80 and their other detoxified variants are particularly useful for immunising against the EIEC pathotype, and thus for preventing dysentery (in particular bacillary dysentery) and HUS (e.g. in children).

SEQ ID NO: 81, 84, and 86 and their other detoxified variants are particularly useful for immunising against the ETEC pathotype, and thus for preventing diarrhea (including travellers' and infant diarrhea).

SEQ ID NOs: 82, 83, and 91 and their other detoxified variants are particularly useful for immunising against the EPEC pathotype, and thus for preventing diarrhea (including infantile diarrhea).

SEQ ID NO: 21, 30, 35, 40, 49, 54, 59, 68, and 73 and their other variants are particularly useful for immunising against the EAEC pathotype, and thus for preventing diarrhea (both acute and chronic).

SEQ ID NO: 22, 28, 36, 41, 47, 55, 56, 60, 66, 74, and 75 and their other variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 23, 42, and 61 and their other variants are particularly useful for immunising against the EIEC pathotype, and thus for preventing dysentery (in particular bacillary dysentery) and HUS (e.g. in children).

SEQ ID NO: 24, 27, 29, 43, 46, 48, 62, 65, and 67 and their other variants are particularly useful for immunising against the ETEC pathotype, and thus for preventing diarrhea (including travellers' and infant diarrhea).

SEQ ID NO: 25, 26, 33, 34, 45, 53, 63, 64, and 72 and their other variants are particularly useful for immunising against the EAEC pathotype, and thus for preventing diarrhea (both acute and chronic).

SEQ ID NO: 79, 85, 93, and 94 and their other are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 80 and their other variants are particularly useful for immunising against the EIEC pathotype, and thus for preventing dysentery (in particular bacillary dysentery) and HUS (e.g. in children).

SEQ ID NO: 81, 84, and 86 and their other variants are particularly useful for immunising against the ETEC pathotype, and thus for preventing diarrhea (including travellers' and infant diarrhea).

SEQ ID NOs: 82, 83, and 91 and their other variants are particularly useful for immunising against the EPEC pathotype, and thus for preventing diarrhea (including infantile diarrhea).

The mammal is preferably a human, but may be e.g. a cow, a pig, a chicken, a cat or a dog, as *E. coli* disease is also problematic in these species [4]. Where the vaccine is for prophylactic use, the human is preferably a child (e.g. a toddler or infant) or a teenager; where the vaccine is for therapeutic use, the human is preferably a teenager or an adult. A vaccine intended for children may also be administered to adults e.g. to assess safety, dosage, immunogenicity, etc.

One way of checking efficacy of therapeutic treatment involves monitoring *E. coli* infection after administration of the compositions of the invention. One way of checking efficacy of prophylactic treatment involves monitoring immune responses, systemically (such as monitoring the level of IgG1 and IgG2a production) and/or mucosally (such as monitoring the level of IgA production), against the antigens in the compositions of the invention after administration of the composition. Typically, antigen-specific serum antibody responses are determined post-immunisation but pre-challenge whereas antigen-specific mucosal antibody responses are determined post-immunisation and post-challenge.

Another way of assessing the immunogenicity of the compositions of the present invention is to express the proteins recombinantly for screening patient sera or mucosal secretions by immunoblot and/or microarrays. A positive reaction between the protein and the patient sample indicates that the patient has mounted an immune response to the protein in question. This method may also be used to identify immunodominant antigens and/or epitopes within antigens.

The efficacy of vaccine compositions can also be determined in vivo by challenging animal models of E. coli infection, e.g., guinea pigs or mice, with the vaccine compositions. A murine model of ExPEC and lethal sepsis is described in reference 152. A cotton rat model is disclosed in ref. 153

Compositions of the invention will generally be administered directly to a patient. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration. Novel direct delivery forms can also include transgenic expression of the polypeptides disclosed herein in foods, e.g., transgenic expression in a potato.

The invention may be used to elicit systemic and/or mucosal immunity, preferably to elicit an enhanced systemic and/or mucosal immunity.

Preferably the enhanced systemic and/or mucosal immunity is reflected in an enhanced TH1 and/or TH2 immune response. Preferably, the enhanced immune response includes an increase in the production of IgG1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

Vaccines of the invention may be used to treat both children and adults. Thus a human patient may be less than 1 year old, 1-5 years old, 5-15 years old, 15-55 years old, or at least 55 years old. Preferred patients for receiving the vaccines are the elderly (e.g. ≥50 years old, ≥60 years old, and preferably ≥65 years), the young (e.g. ≤5 years old), hospitalised patients, healthcare workers, armed service and military personnel, pregnant women, the chronically ill, or immunodeficient patients. The vaccines are not suitable solely for these groups, however, and may be used more generally in a population.

Vaccines of the invention are particularly useful for patients who are expecting a surgical operation, or other hospital in-patients. They are also useful in patients who will be catheterized. They are also useful in adolescent females (e.g. aged 11-18) and in patients with chronic urinary tract infections.

Vaccines of the invention may be administered to patients at substantially the same time as (e.g. during the same medical consultation or visit to a healthcare professional or vaccination centre) other vaccines e.g. at substantially the same time as a measles vaccine, a mumps vaccine, a rubella vaccine, a MMR vaccine, a varicella vaccine, a MMRV vaccine, a diphtheria vaccine, a tetanus vaccine, a pertussis vaccine, a DTP vaccine, a conjugated H. influenzae type b vaccine, an inactivated poliovirus vaccine, a hepatitis B virus vaccine, a meningococcal conjugate vaccine (such as a tetravalent A-C-W135-Y vaccine), a respiratory syncytial virus vaccine, etc.

Nucleic Acid Immunisation

The immunogenic compositions described above include polypeptide antigens. In all cases, however, the polypeptide antigens can be replaced by nucleic acids (typically DNA) encoding those polypeptides, to give compositions, methods and uses based on nucleic acid immunisation. Nucleic acid immunisation is now a developed field (e.g. see references 154 to 161 etc.).

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA delivery techniques are described in, for example, references 162 to 167. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 168 to 171).

Viral-based vectors for delivery of a desired nucleic acid and expression in a desired cell are well known in the art. Exemplary viral-based vehicles include, but are not limited to, recombinant retroviruses (e.g. references 172 to 182), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 183 to 188). Administration of DNA linked to killed adenovirus [189] can also be employed.

Non-viral delivery vehicles and methods can also be employed, including, but not limited to, polycationic condensed DNA linked or unlinked to killed adenovirus alone [e.g. 189], ligand-linked DNA [190], eukaryotic cell delivery vehicles cells [e.g. refs. 191 to 195] and nucleic charge neutralization or fusion with cell membranes. Naked DNA can also be employed. Exemplary naked DNA introduction methods are described in refs. 196 and 197. Liposomes (e.g. immunoliposomes) that can act as gene delivery vehicles are described in refs. 198 to 202. Additional approaches are described in references 203 & 204.

Further non-viral delivery suitable for use includes mechanical delivery systems such as the approach described in ref. 204. Moreover, the coding sequence and the product of expression of such can be delivered through deposition of photopolymerized hydrogel materials or use of ionizing radiation [e.g. refs. 205 & 206]. Other conventional methods for gene delivery that can be used for delivery of the coding sequence include, for example, use of hand-held gene transfer particle gun [207] or use of ionizing radiation for activating transferred genes [205 & 206].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

General

The practice of the present invention will employ, unless otherwise indicated, conventional methods of chemistry, biochemistry, molecular biology, immunology and pharmacology, within the skill of the art. Such techniques are explained fully in the literature. See, e.g., references 208-215, etc.

The term "comprising" encompasses "including" as well as "consisting" e.g. a composition "comprising" X may consist exclusively of X or may include something additional e.g. X+Y.

The term "about" in relation to a numerical value x means, for example, x±10%.

"GI" numbering is used herein. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed.

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of ref. 216. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 217.

One of skill in the art would understand that "isolated" means altered "by the hand of man" from its natural state, i.e., if it occurs in nature, it has been changed or removed from its original environment, or both. For example, a polynucleotide or a polypeptide naturally present in a living organism is not "isolated" when in such living organism, but the same polynucleotide or polypeptide separated from the coexisting materials of its natural state is "isolated," as the term is used in this disclosure. Further, a polynucleotide or polypeptide that is introduced into an organism by transformation, genetic manipulation or by any other recombinant method would be understood to be "isolated" even if it is still present in said organism, which organism may be living or non-living, except where such transformation, genetic manipulation or other recombinant method produces an organism that is otherwise indistinguishable from the naturally occurring organism.

BRIEF DESCRIPTION OF DRAWINGS

FIG. 1A-FIG. 1K show a CLUSTALW alignment of SEQ ID NOs: 2 to 16. Different portions of the alignment are shown in FIG. 1A, FIG. 1B, FIG. 1C, FIG. 1D, FIG. 1E, FIG. 1F, FIG. 1G, FIG. 1H, FIG. 1I, FIG. 1J, and FIG. 1K. The N-terminal regions that may be removed to increase solubility while maintaining substantially the same immunogenicity are shown at the bottom of the alignment. The N-terminal region up to the gly-ser linker or gly-ser region is denoted with "G" and the proline-rich region is denoted with "P."

FIG. 2 shows the amino acid identity between pairs of sequences.

FIG. 4A-FIG. 4B shows the Western Blot of pathogenic and non pathogenic *E. coli* strains using an anti-AcfD (orf3526) serum. FIG. 4A is a Western Blot of the total cell lysate. FIG. 4B is a Western Blot of the supernatant from the culture. The lanes in each of FIG. 4A and FIG. 4B from left to right are as follows: Lane M—marker proteins with the molecular weight in kDa of each marker protein shown along the left side of FIG. 4A; 1—IHE3034; 2—CFT073; 3—536; 4—BL21; 5—MG 1655; 6—W3110; 7—NISSLE1917; 8—IHE3034ΔAcfD. As observed from the analysis, pathogenic strains (IHE3034, lane 1; 536, lane 3) express and secrete AcfD (orf3526) while non-pathogenic strains (MG1655, lane 5; W3110, lane 6; Nissle 1917, lane 7) express the protein but its secretion is defective. Strains CFT073 (lane 2) and IHE3034ΔAcfD (lane 8) are used as negative control, since they don't harbor the AcfD (orf3526) gene. BL21 strain (lane 4) is a lab strain used as positive control, since it expresses and secretes AcfD (orf3526).

FIG. 5A is an SDS-PAGE gradient gel (4-12% MOPS buffer) of samples at 37° C. comparing the pellet (left lane for each protein or fragment) to the supernatant (right lane for each protein or fragment). The lanes from left to right are: Molecular weight markers (191 kDa, 97 kDa and 64 kDa bands are labelled), control bacteria transformed with the pET expression vector with no insert, bacterial expression of 3526 (his tag, leader peptide removed), bacterial expression of L3526 (his tag, full length), bacterial expression of L3526-2stop (full length with a stop codon before His tag), bacterial expression of ΔG3526 (his tag, removal of the N-terminus of AcfD (orf3526) to the flexible glycine-serine linker), and bacterial expression of ΔP3526 (his tag+removal of the N-terminus of AcfD (orf3526) through the proline rich region). FIG. 5B is an SDS-PAGE gradient gel (4-12% MOPS buffer) of samples at 25° C. following the same order for the lanes as panel (A) FIG. 5A.

FIG. 6A is an SDS-PAGE gel (12% MOPS buffer) of samples at from bacteria expressing 3526 (his tag, leader peptide removed), cultured at 25° C. comparing fractions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three elutions with 500 mM imidazole buffer. FIG. 6B is an SDS-PAGE gel (12% MOPS buffer) of samples at from bacteria expressing ΔG3526 (his tag, removal of the N-terminus of AcfD (orf3526) to the flexible glycine-serine linker) cultured at 25° C. comparing fractions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three elutions with 500 mM imidazole buffer. FIG. 6C is an SDS-PAGE gel (12% MOPS buffer) of samples from bacteria expressing ΔP3526 (his tag, removal of the N-terminus of AcfD (orf3526) through the proline rich region), cultured at 25° C. comparing fractions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three elutions with 500 mM imidazole buffer.

BRIEF DESCRIPTION OF SEQUENCE LISTING

Figure 3:
FIG. 3 shows gel analysis of purified protein, with high MW bands visible in the absence of DTT.

| SEQ ID | Description |
| --- | --- |
| | SEQ ID NOs: 1-19 = full length amino acid sequences |
| 1 | Amino acid sequence from NMEC strain IHE3034 |
| 2 | Amino acid sequence from EAEC strain 101-1 (GI: 83587587) |

-continued

| SEQ ID | Description |
|---|---|
| 3 | Amino acid sequence from UPEC strain 536 (GI: 110643204) |
| 4 | Amino acid sequence from EIEC strain 53638 (GI: 75515237) |
| 5 | Amino acid sequence from ETEC strain B7A (GI: 75227618) |
| 6 | Amino acid sequence from EPEC strain E110019 (GI: 75239450) |
| 7 | Amino acid sequence from EPEC strain E22 (GI: 75259912) |
| 8 | Amino acid sequence from ETEC strain E24377A (GI: 157156747) |
| 9 | Amino acid sequence from UPEC strain F11 (GI: 75241179) |
| 10 | Amino acid sequence from ETEC strain H10407 |
| 11 | Amino acid sequence from EAEC strain O42 |
| 12 | Amino acid sequence from commensal strain HS (GI: 157162442) |
| 13 | Amino acid sequence from commensal strain W3110 (GI: 89109748) |
| 14 | Amino acid sequence from antibiotic-resistant strain SECEC |
| 15 | Amino acid sequence from EPEC strain E2348/69 |
| 16 | Amino acid sequence from EAEC strain 55989 |
| 17 | Amino acid sequence from UPEC strain IAI39 |
| 18 | Amino acid sequence from UPEC strain UMN026 |
| 19 | Amino acid sequence from NMEC strain S88 |
| | SEQ ID NOs: 20-38 = C-terminal deletion amino acid sequences |
| 20 | Amino acid sequence from NMEC strain IHE3034 with C-terminal deletion |
| 21 | Amino acid sequence from EAEC strain 101-1 (GI: 83587587) with C-terminal deletion |
| 22 | Amino acid sequence from UPEC strain 536 (GI: 110643204) with C-terminal deletion |
| 23 | Amino acid sequence from EIEC strain 53638 (GI: 75515237) with C-terminal deletion |
| 24 | Amino acid sequence from ETEC strain B7A (GI: 75227618) with C-terminal deletion |
| 25 | Amino acid sequence from EPEC strain E110019 (GI: 75239450) with C-terminal deletion |
| 26 | Amino acid sequence from EPEC strain E22 (GI: 75259912) with C-terminal deletion |
| 27 | Amino acid sequence from ETEC strain E24377A (GI: 157156747) with C-terminal deletion |
| 28 | Amino acid sequence from UPEC strain F11 (GI: 75241179) with C-terminal deletion |
| 29 | Amino acid sequence from ETEC strain H10407 with C-terminal deletion |
| 30 | Amino acid sequence from EAEC strain O42 with C-terminal deletion |
| 31 | Amino acid sequence from commensal strain HS (GI: 157162442) with C-terminal deletion |
| 32 | Amino acid sequence from commensal strain W3110 (GI: 89109748) with C-terminal deletion |
| 33 | Amino acid sequence from antibiotic-resistant strain SECEC with C-terminal deletion |
| 34 | Amino acid sequence from EPEC strain E2348/69 with C-terminal deletion |
| 35 | Amino acid sequence from EAEC strain 55989 with C-terminal deletion |
| 36 | Amino acid sequence from UPEC strain IAI39 with C-terminal deletion |
| 37 | Amino acid sequence from UPEC strain UMN026 with C-terminal deletion |
| 38 | Amino acid sequence from NMEC strain S88 with C-terminal deletion |
| | SEQ ID NOs: 39-57 = N-terminal deletion amino acid sequences |
| 39 | Amino acid sequence from NMEC strain IHE3034 with N-terminal deletion |
| 40 | Amino acid sequence from EAEC strain 101-1 (GI: 83587587) with N-terminal deletion |
| 41 | Amino acid sequence from UPEC strain 536 (GI: 110643204) with N-terminal deletion |
| 42 | Amino acid sequence from EIEC strain 53638 (GI: 75515237) with N-terminal deletion |
| 43 | Amino acid sequence from ETEC strain B7A (GI: 75227618) with N-terminal deletion |
| 44 | Amino acid sequence from EPEC strain E110019 (GI: 75239450) with N-terminal deletion |
| 45 | Amino acid sequence from EPEC strain E22 (GI: 75259912) with N-terminal deletion |
| 46 | Amino acid sequence from ETEC strain E24377A (GI: 157156747) with N-terminal deletion |
| 47 | Amino acid sequence from UPEC strain F11 (GI: 75241179) with N-terminal deletion |
| 48 | Amino acid sequence from ETEC strain H10407 with N-terminal deletion |
| 49 | Amino acid sequence from EAEC strain O42 with N-terminal deletion |
| 50 | Amino acid sequence from commensal strain HS (GI: 157162442) with N-terminal deletion |
| 51 | Amino acid sequence from commensal strain W3110 (GI: 89109748) with N-terminal deletion |
| 52 | Amino acid sequence from antibiotic-resistant strain SECEC with N-terminal deletion |
| 53 | Amino acid sequence from EPEC strain E2348/69 with N-terminal deletion |

| SEQ ID | Description |
|---|---|
| 54 | Amino acid sequence from EAEC strain 55989 with N-terminal deletion |
| 55 | Amino acid sequence from UPEC strain IAI39 with N-terminal deletion |
| 56 | Amino acid sequence from UPEC strain UMN026 with N-terminal deletion |
| 57 | Amino acid sequence from NMEC strain S88 with N-terminal deletion |
| | SEQ ID NOs: 58-76 = E1305A point mutation amino acid sequences |
| 58 | Amino acid sequence from NMEC strain IHE3034 with an E1305A point mutation |
| 59 | Amino acid sequence from EAEC strain 101-1 (GI: 83587587) with an E1305A point mutation |
| 60 | Amino acid sequence from UPEC strain 536 (GI: 110643204) with an E1305A point mutation |
| 61 | Amino acid sequence from EIEC strain 53638 (GI: 75515237) with an E1305A point mutation |
| 62 | Amino acid sequence from ETEC strain B7A (GI: 75227618) with an E1305A point mutation |
| 63 | Amino acid sequence from EPEC strain E110019 (GI: 75239450) with an E1305A point mutation |
| 64 | Amino acid sequence from EPEC strain E22 (GI: 75259912) with an E1305A point mutation |
| 65 | Amino acid sequence from ETEC strain E24377A (GI: 157156747) with an E1305A point mutation |
| 66 | Amino acid sequence from UPEC strain F11 (GI: 75241179) with an E1305A point mutation |
| 67 | Amino acid sequence from ETEC strain H10407 with an E1305A point mutation |
| 68 | Amino acid sequence from EAEC strain O42 with an E1305A point mutation |
| 69 | Amino acid sequence from commensal strain HS (GI: 157162442) with an E1305A point mutation |
| 70 | Amino acid sequence from commensal strain W3110 (GI: 89109748) with an E1305A point mutation |
| 71 | Amino acid sequence from antibiotic-resistant strain SECEC with an E1305A point mutation |
| 72 | Amino acid sequence from EPEC strain E2348/69 with an E1305A point mutation |
| 73 | Amino acid sequence from EAEC strain 55989 with an E1305A point mutation |
| 74 | Amino acid sequence from UPEC strain IAI39 with an E1305A point mutation |
| 75 | Amino acid sequence from UPEC strain UMN026 with an E1305A point mutation |
| 76 | Amino acid sequence from NMEC strain S88 with an E1305A point mutation |
| | SEQ ID NOs: 77-95 = orf3526C fragment amino acid sequences |
| 77 | Amino acid sequence from NMEC strain IHE3034 with the N-terminal ΔG region and the C-terminal portion including the zinc-binding motif deleted |
| 78 | Amino acid sequence from EAEC strain 101-1 (GI: 83587587) with the N-terminal ΔG region and the C-terminal portion including the zinc-binding motif deleted |
| 79 | Amino acid sequence from UPEC strain 536 (GI: 110643204) with the N-terminal ΔG region and the C-terminal portion including the zinc-binding motif deleted |
| 80 | Amino acid sequence from EIEC strain 53638 (GI: 75515237) with the N-terminal ΔG region and the C-terminal portion including the zinc-binding motif deleted |
| 81 | Amino acid sequence from ETEC strain B7A (GI: 75227618) with the N-terminal ΔG region and the C-terminal portion including the zinc-binding motif deleted |
| 82 | Amino acid sequence from EPEC strain E110019 (GI: 75239450 with the N-terminal ΔG region and the C-terminal portion including the zinc-binding motif deleted |
| 83 | Amino acid sequence from EPEC strain E22 (GI: 75259912) with the N-terminal ΔG region and the C-terminal portion including the zinc-binding motif deleted |
| 84 | Amino acid sequence from ETEC strain E24377A (GI: 157156747) with the N-terminal ΔG region and the C-terminal portion including the zinc-binding motif deleted |
| 85 | Amino acid sequence from UPEC strain F11 (GI: 75241179) with the N-terminal ΔG region and the C-terminal portion including the zinc-binding motif deleted |
| 86 | Amino acid sequence from ETEC strain H10407 with the N-terminal ΔG region and the C-terminal portion including the zinc-binding motif deleted |
| 87 | Amino acid sequence from EAEC strain O42 with the N-terminal ΔG region and the C-terminal portion including the zinc-binding motif deleted |
| 88 | Amino acid sequence from commensal strain HS (GI: 157162442) with the N-terminal ΔG region and the C-terminal portion including the zinc-binding motif deleted |

-continued

| SEQ ID | Description |
|---|---|
| 89 | Amino acid sequence from commensal strain W3110 (GI: 89109748) with the N-terminal ΔG region and the C-terminal portion including the zinc-binding motif deleted |
| 90 | Amino acid sequence from antibiotic-resistant strain SECEC with the N-terminal ΔG region and the C-terminal portion including the zinc-binding motif deleted |
| 91 | Amino acid sequence from EPEC strain E2348/69 with the N-terminal ΔG region and the C-terminal portion including the zinc-binding motif deleted |
| 92 | Amino acid sequence from EAEC strain 55989 with the N-terminal ΔG region and the C-terminal portion including the zinc-binding motif deleted |
| 93 | Amino acid sequence from UPEC strain IAI39 with the N-terminal ΔG region and the C-terminal portion including the zinc-binding motif deleted |
| 94 | Amino acid sequence from UPEC strain UMN026 with the N-terminal ΔG region and the C-terminal portion including the zinc-binding motif deleted |
| 95 | Amino acid sequence from NMEC strain S88 with the N-terminal ΔG region and the C-terminal portion including the zinc-binding motif deleted |
| 96/97 | Zinc binding motifs |
| 98-109 | Primers |
| 110-111 | IC31 sequences |
| 112-126 | Motifs in zinc metalloproteases |

MODES FOR CARRYING OUT THE INVENTION

One of the antigens disclosed in reference 5 is annotated as accessory colonization factor D (AcfD) precursor (orf3526) (amino acid SEQ ID NO: 2 herein) from NMEC strain IHE3034. This protein has been expressed and purified, and it confers protection against ExPEC strains in a sepsis animal model.

Sequences were obtained for the orthologs in various other E. coli strains. The amino acid sequence seen in IHE3034 was also seen in strains APECO1 and UTI89, but 14 extra sequences were found (SEQ ID NOs: 3 to 16). FIG. 1 shows an alignment of SEQ ID NOs: 2 to 16. The 30 N-terminal amino acids are 100% conserved, and these include the signal peptide (aa 1-23) and the N-terminus cysteine of the native lipoprotein.

Some strains had a frameshift mutation in the AcfD (orf3526) gene, resulting in no expression of the polypeptide. The acfD gene was totally absent from strains CFT073, EDL933, Sakai and B171.

FIG. 2 shows the % identity between the amino acid sequences. The labels are SEQ ID NOs, except for MG1655, RS218, DH10B, APECO1 and UTI89 where the strain name is used. The lowest level of identity (boxed in FIG. 2) was 85.9%, between SEQ ID NOs: 2 and 4 (both ExPEC strains).

EXAMPLE 1

Immunogenicity of the Full Length AcfD (orf3526)

The AcfD (orf3526) sequence from strain IHE3034 was cloned and expressed from a plasmid as a recombinant His-tagged protein without a leader peptide, in an E. coli host. Protein was purified and analysed. Gel filtration showed a much higher molecular weight than predicted based solely on the amino acid sequence. Gel analysis in the absence of DTT, but not in its presence, shows higher molecular weight forms of the protein (FIG. 3). Thus the protein is likely to form oligomers.

Sera raised against AcfD (orf3526) were used in western blots against total cell lysates (FIG. 4(A)) or culture supernatants precipitated with 60% TCA (FIG. 4(B)). The sera recognised a ~150 kDa protein in lysates from both pathogenic and commensal strains. They did not react with this band in lysates from CFT073 or from an AcfD (orf3526) knockout mutant of IHE3034. Reactivity with proteins in the supernatants indicates that the protein may be secreted.

CD1 mice (5 weeks old) were immunized sub-cutaneously using 20 µg of the antigen plus Freund's adjuvant (or other adjuvant as indicated below). The mice were inoculated at 0, 21, and 35 days. Fourteen days after the third inoculation, the mice were challenged with a lethal dose (LD80) of a pathogenic strain of E. coli. Blood was collected from the tail 24 hours after challenge to evaluate bacteremia. The mortality was monitored for four days post-challenge. The protection rate may be calculated as (% dead in control group (no immunization)−% dead in experimental group (immunized))/% dead in control group×100.

TABLE 1

| | Sepsis animal model | | |
|---|---|---|---|
| Candidates | Survival with vaccination (%) | Survival without vaccination (%) | P value |
| 20 µg 3526/alum | 64/78 (82) | 9/80 (11) | 0.0001 |

Thus, the AcfD precursor (orf3526) is an effective candidate for use as a vaccine or vaccine component.

To further demonstrate the utility of the AcfD precursor (orf3526) as a candidate for a vaccine or a vaccine component, the AcfD precursor (orf3526) was tested for its ability to provide cross protection against other pathogenic strains of E. coli using the animal sepsis model as indicated above. The results of these tests are indicated in Table 2 below (with the results from Table 1 included for comparison purposes).

TABLE 2

| 20 µg 3526/alum Challenge Strain | Sepsis animal model | | |
|---|---|---|---|
| (percent identity to IHE3034) | Survival with vaccination (%) | Survival without vaccination (%) | P value |
| IHE3034 (100) | 64/78 (82) | 9/80 (11) | 0.0001 |
| 9855/93 (87) | 9/16 (56) | 4/15 (26) | 0.14 |
| BK658 (98) | 4/8 (50) | 1/8 (12.5) | 0.28 |
| B616 (100C) | 6/8 (78) | 0/8 (0) | 0.007 |
| 536 (86) | 6/7 (85) | 3/8 (37.5) | 0.11 |

Thus, the AcfD precursor (orf3526) is an effective candidate for use as a vaccine or vaccine component not just against the strain from which the protein was derived, but also against related strains, thus increasing the utility. Based upon the similarity between the response to the AcfD precursor (orf3526) and the response to the three immunogenic fragments tested below (3526A, 3526B, and 3526C), one would expect that these three fragments would provide similar cross protection as well.

EXAMPLE 2

Fragments of AcfD (orf3526) with Increased Solubility

Figure 5A:
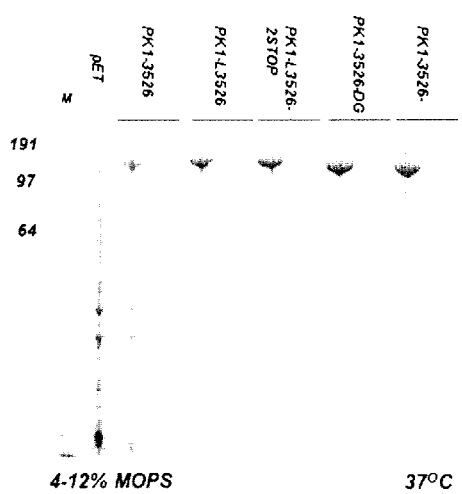
FIG. 5A-FIG. 5B shows a comparison of solubility of the AcfD (orf3526) protein and various fragments of the protein.
Figure 5B:
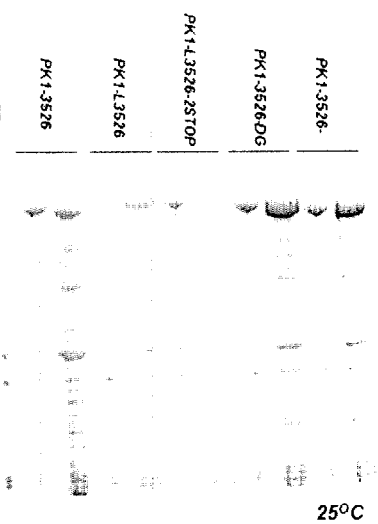
Figures 6A, 6B, 6C:
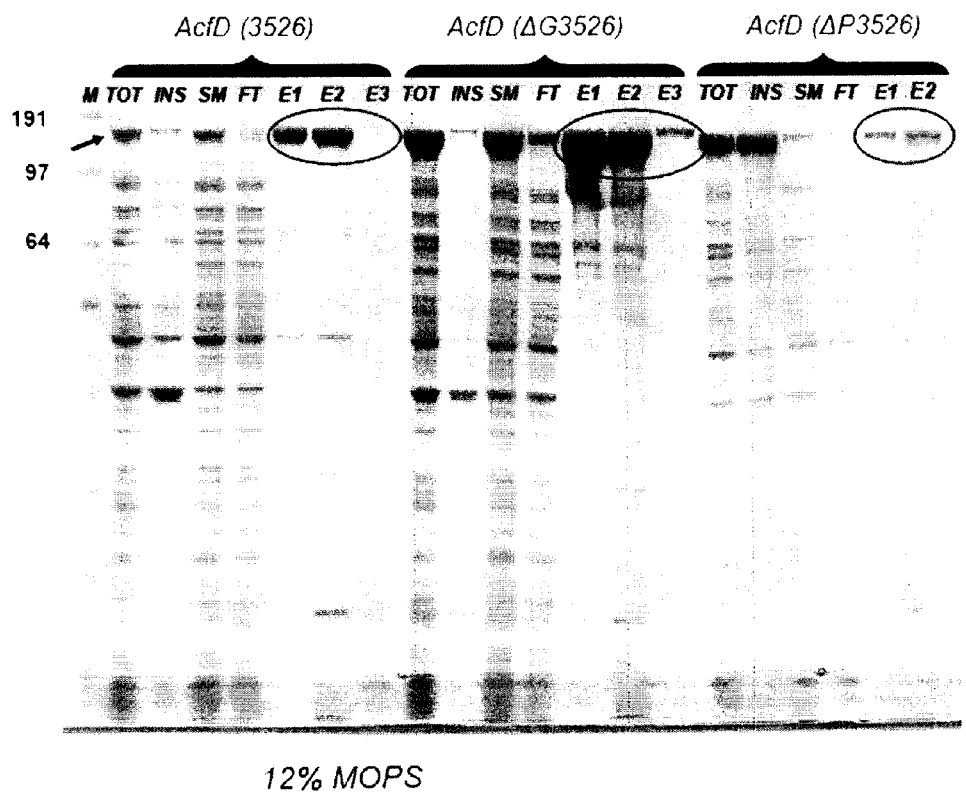
FIG. 6A-FIG. 6C shows a comparison of expression and purification of the AcfD (orf3526) protein and various fragments of the protein.
Figure 7:
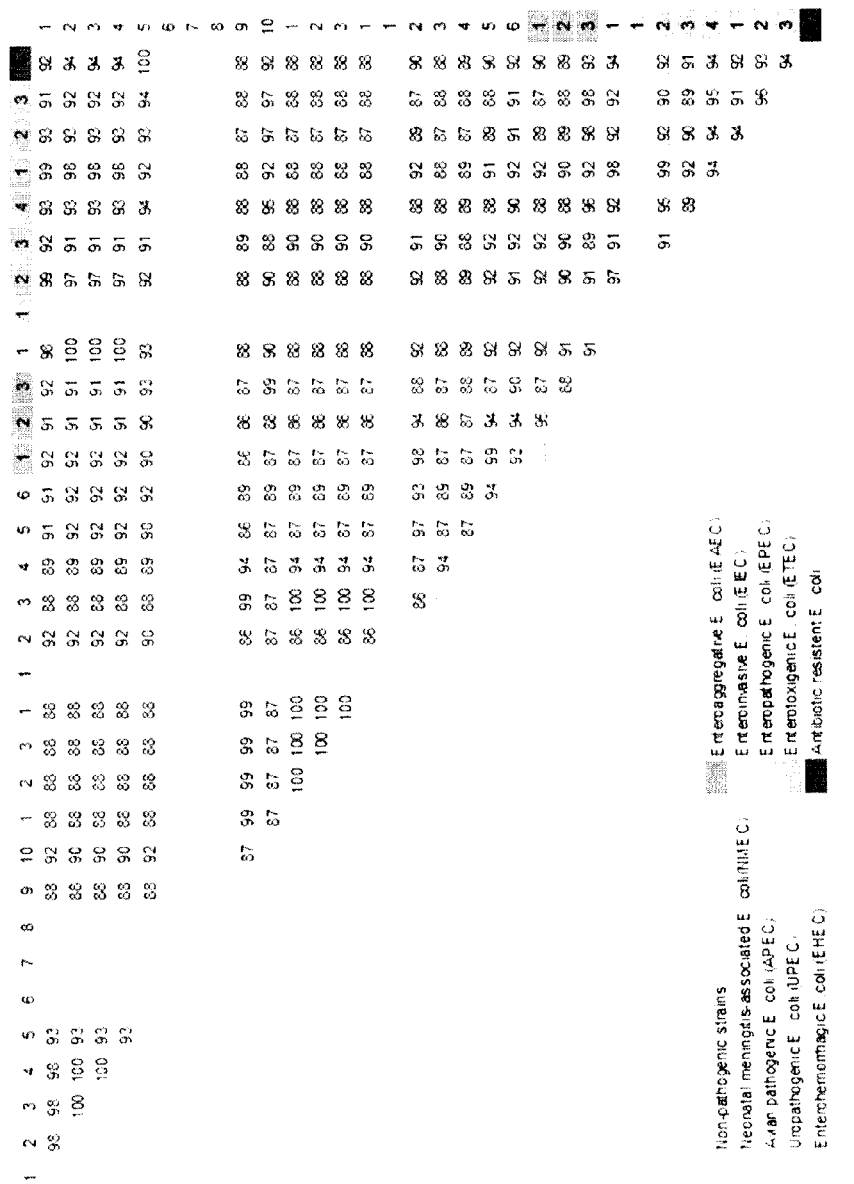
FIG. 7 shows the amino acid identity between additional pairs of sequences. Sixteen Enterohemorrhagic *E. coli* (EHEC) were not found to have AcfD (orf3526) gene (not shown). The sequences (where represented) from left to right or top to bottom are as follows: 10 non-pathogenic or commensal strains (1: a commensal *E. coli* strain, 2: DH10B strain, 3: MG1655 strain, 4: W3110 strain (SEQ ID NO:14); 5: HS strain (SEQ ID NO:13); 9: another commensal *E. coli* strain; and 10: yet another commensal *E. coli* strain); three NMEC strains (1: NMEC strain RS218; 2: NMEC strain IHE3034 (SEQ ID NO:2); and 3: NMEC strain S88 (SEQ ID NO:141)); one APEC strain (1: APEC 01 strain); six UPEC strains (2: UPEC strain 536 (SEQ ID NO:4); 3: UTI89; 4: UPEC strain F11 (SEQ ID NO:10); 5: UPEC strain IA139 (SEQ ID NO:133); and 6: UPEC strain UMN026 (SEQ ID NO:137)); three EAEC strains (1: EAEC strain 101-1 (SEQ ID NO:3); 2: EAEC strain 042 (SEQ ID NO:12; and 3: EAEC strain 55989 (SEQ ID NO:129)); one EIEC strain (1: EIEC strain 53638 (SEQ ID NO:5)); four EPEC strains (2: EPEC strain E22 (SEQ ID NO: 8)); 3: EPEC strain E2348/69 (SEQ ID NO:16); and 4: EPEC strain E110019 (SEQ ID NO:7)); three ETEC strains (1: ETEC strain B7A (SEQ ID NO:6); 2: ETEC strain E24377A (SEQ ID NO:9); and 3: ETEC strain H 10407 (SEQ ID NO:11)); and one antibiotic resistant strain (1: antibiotic-resistant strain SECEC (SEQ ID NO:15)).
Figure 8:
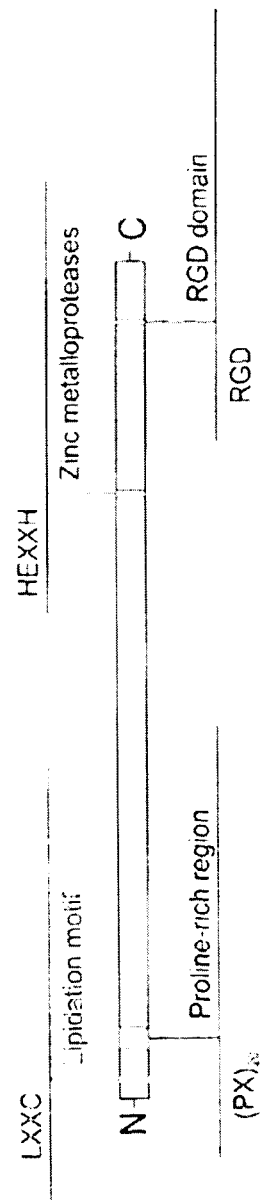
FIG. 8 shows the sequence motifs identified in AcfD (orf3526) including from left to right: a lipidation motif; a proline rich region, a WxxxE motif, a zinc binding motif, and an RGD domain.
Figure 9:
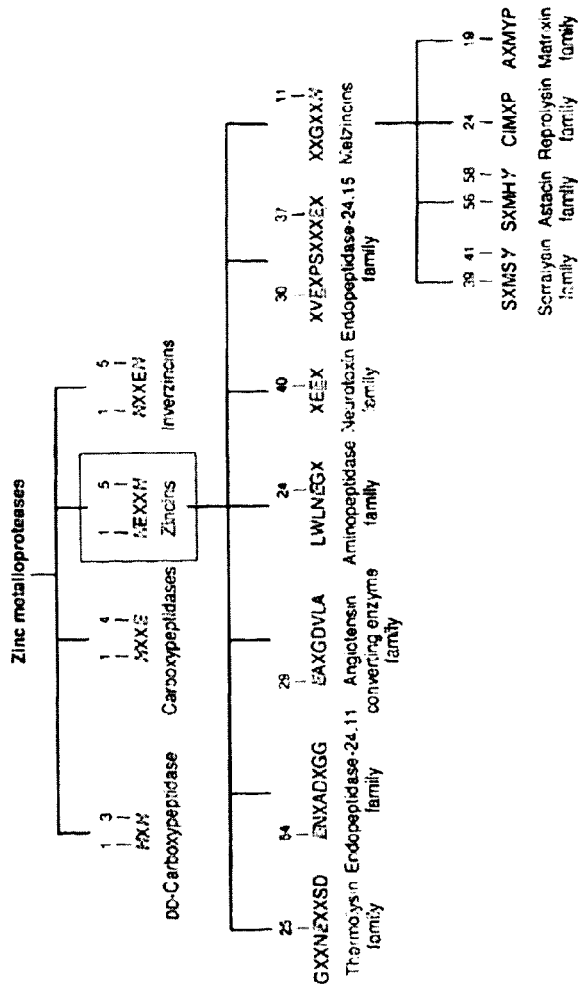
FIG. 9 shows the family relationships of the various zinc metalloproteases. The zincins are highlighted with a grey box as the zincin motif is the motif found in AcfD (orf3526) (See FIG. 8). (DD-Carboxypeptidase (SEQ ID NO: 112), Carboxypeptidases (SEQ ID NO: 113), Zincins (SEQ ID NO: 114), Inverzincins (SEQ ID NO: 115), Thermolysin family (SEQ ID NO: 116), Endopeptidase-24.11 family (SEQ ID NO: 117), Angiotensin converting enzyme family (SEQ ID NO: 118), Aminopeptidase family (SEQ ID NO: 119), Neurotoxin family (SEQ ID NO: 120), Endopeptidase-24.15 family (SEQ ID NO: 121), Metzincins (SEQ ID NO: 122), Serralysin family (SEQ ID NO: 123), Astacin family (SEQ ID NO: 124), Reprolysin family (SEQ ID NO: 125), Matrixin family (SEQ ID NO: 126)).

Unexpectedly, AcfD (orf3526) protein displayed low solubility even though the protein is a secreted protein. As shown in FIG. 5(B), removal of the N-terminus of AcfD (orf3526) through the gly-ser linker or gly-ser region significantly increased solubility when expressed at 25° C. (See pK1-ΔG3526 FIG. 5(B)). Similarly removal of the N-terminus of AcfD (orf3526) through the proline rich region significantly increased solubility when expressed at 25° C. (See pK1-ΔP3526 FIG. 5(B)).

To confirm that both fragments had substantially the same immunogenicity as the full length AcfD (orf3526), the fragments were purified. The purified fragments were used in three immunization experiments in mice, adjuvanted with Freund's complete adjuvant. Immunized mice were then challenged with a sublethal dose of *E. coli*. Immunization with AcfD (orf3526) with the N-terminus through the gly-ser linker or gly-ser region removed protected 100% of the mice from death, whereas death occurred in 90% of the animals in the non-immunized control group. Immunization with AcfD (orf3526) with the N-terminus through the proline rich region removed protected 90% of the mice from death, whereas death occurred in 90% of the animals in the non-immunized control group.

Expression and Purification

Bacteria with one of the three constructs expressing his-tagged variants of AcfD (orf3526) were cultured in 30 ml of medium and induced to express the AcfD (orf3526) variant at 25° C. (AcfD (orf3526) without the leader peptide (3526), AcfD (orf3526) with the N-terminus removed through the gly-ser linker or gly-ser region (ΔG3526), and AcfD (orf3526) with the N-terminus removed through the proline rich region (ΔP3526). The bacteria were harvested and lysed by sonication. The soluble fractions were isolated and loaded on an IMAC column. The column was washed three times with 20 mM imidazole buffer. The AcfD (orf3526) variants were then eluted with three washes of 500 mM imidazole buffer. As shown in FIG. 6, removal of the N-terminus of AcfD (orf3526) through the gly-ser linker or gly-ser region significantly increased solubility and yield of purified protein. The yield obtained was estimated by Bradford assay to be as follows: 0.18 mg of 3526 and 2.34 mg ΔG3526.

EXAMPLE 3

AcfD (orf3526) Mutants with Reduced Toxicity

A zinc binding motif was identified in the AcfD (orf3526) protein (See FIG. 8). The zincin zinc metalloprotease motif is also found in StcE (Secreted protease of C1 esterase inhibitor from EHEC) which is a protein secreted by EHEC that is involved in the pathogenesis of such *E. coli*.

```
                                     (SEQ ID NO: 96)
StcE                      HEVGHNYGLGH
```

-continued

```
                                     (SEQ ID NO: 97)
AcfD (orf3526)            HEVGHNAAETP
```

Given that this motif is conserved in all variants of AcfD (orf3526) and EHEC was the only pathotype in which AcfD (orf3526) was not identified, it was surmised that AcfD (orf3526) similarly is a zinc metalloprotease involved in the pathogenicity of the *E. coli* pathotypes in which it is expressed and secreted. Therefore, inactivation of the toxicity of AcfD (orf3526) was sought. One of skill in the art would have no difficulty in modifying AcfD (orf3526) to inactivate the metalloprotease. As the Glu residue of the motif is known to be most important to catalytic activity while the two His residues coordinate the Zinc, the Glu was mutated to Ala as an exemplary mutation inactivating the metalloprotease activity—SEQ ID NOs: 58-76 (See, e.g., Microbiology and Molecular Biology Reviews, September 1998, p. 597-635, Vol. 62, No. 3). In addition, two additional detoxified variants were designed: one with the C-terminus deleted—SEQ ID NOs: 20-38, and one with the N-terminus deleted—SEQ ID NOs: 39-57.

Test of In Vitro Toxicity of Full Length AcfD (orf3526)

Two different cell lines were tested for their ability to assay toxicity of the AcfD (orf3526) protein: human bone marrow endothelial cells (HBMEC) and Chinese hamster ovary cells (CHO cells). For HBMEC, the effect of increasing doses of AcfD (orf3526) protein (0.1 μg/ml, 1 μg/ml, and 10 μg/ml) was compared to TNF-α (as a positive control). The TNF-α treated cells showed an average of ~22.5% cell death (average of three experiments) while the highest dose of AcfD (orf3526) protein showed only an average of ~5% cell death (average of three experiments) as compared to the negative control which showed only an average of ~2.5% cell death (average of three experiments). For CHO cells, the effect of increasing doses of AcfD (orf3526) protein (1 μg/ml, 10 μg/ml, and 100 μg/ml) was compared to TNF-α (as a positive control) by measuring the change in potential difference over time due to the alteration of the cytoskeleton of the CHO cells. At the highest level of AcfD (orf3526) protein test, a significant decrease was detected after 46 hours, but the decrease in response to TNF-α was notably greater.

Thus, while a preferred test for toxicity with a strong signal has not been identified, the fragments identified below still have significant utility. As discussed above, these three fragment should provide a similar degree of cross protection as the full length version tested above. Furthermore, commensal *E. coli* is a preferred strain for expression of AcfD (orf3526) protein. However, as indicated FIG. 4, commensal *E. coli* express a version of AcfD (orf3526) protein, but do not secrete the protein. Thus, expression of a fragment of an AcfD (orf3526) protein provides the advantage of allowing separation of the fragment from the endogenous AcfD (orf3526) protein based upon the size difference without needing an affinity purification tag.

Cloning and Expression-3526A and 3526B

Mutants were obtained using GeneTailor site-directed mutagenesis system (Invitrogen). Genes were cloned in pET-21b vectors (Novagen) and transformed in DH5α-T1 chemically competent cells for propagation (Invitrogen). BL21 (DE3) chemically competent cells were used for expression. All candidates were cloned and expressed without the signal sequence and as his-tag fusion proteins, being purified by affinity chromatography.

Primers Used for Amplification of Fragments (Final Column is SEQ ID NO:):

```
3526A  3526F  GGAATTCCATATGTGTGATGGTGGTGG NdeI  98
              TTCA
```

```
                     -continued
      3526AR  CCGCTCGAGGTTGTTCACCACCGATTT  XhoI   99

3526B 3526BF  GGAATTCCATATGGATCCGCAAGGGTA  NdeI  100
              TCC

3526R   CCGCTCGAGCTCGGCAGACATCTTATG  XhoI  101
```

Primers Used for Mutation:

```
              Oligo   Nucleotide sequence
Sample        name    (5' - 3')

3526E1305A    3526GTF1 ACGACTGGCTGATTTGGCACGCAGTC  102
                       GGTCATA

3526GTR1 GTGCCAAATCAGCCAGTCGTTCAGCG  103
                       GCGT
```

Immunogenicity-3526A and 3526B

To confirm that both fragments and the point mutation had substantially the same immunogenicity as the full length AcfD (orf3526), the fragments were purified. The purified fragments were used in three immunization experiments in mice, adjuvanted with Freund's complete adjuvant. Immunized mice were then challenged with a lethal dose of *E. coli*. Results of the challenge are shown in Table 3 below.

TABLE 3

| | Sepsis animal model | | |
|---|---|---|---|
| Candidates | Survival with vaccination (%) | Survival without vaccination (%) | P value |
| 3526A (AcfD - C-term deletion) | 7/8 (87.5) | 1/8 (12.5) | 0.01 |
| 3526B (AcfD - N-term deletion) | 6/8 (75) | 1/8 (12.5) | 0.04 |

Cloning and Expression-ΔG3526C

As an additional confirmation, a construct was designed that combined the ΔG3526 N-terminal deletion that improved solubility with deletion of the C-terminus through the zinc motif (ΔG3526C). Exemplary constructs are provided as SEQ ID NOs: 77 to 95.

A non-his-tagged expression vector for the ΔG3526C (*E. coli* strain IHE3034—SEQ ID NO:77) construct was obtained by PCR using the primers indicated below (ΔG3526A/C_For and ΔG3526C NatRev). The amplified PCR fragment was digested with NdeI and XhoI and ligated into a pET-24b(+) vector (Novagen) and transformed in DH5α-T1 chemically competent cells for propagation (Invitrogen). BL21 (DE3) chemically competent cells were used for expression.

A his-tagged expression vector for the ΔG3526C (*E. coli* strain IHE3034—SEQ ID NO:77) construct was obtained using Polymerase Incomplete Primer Extension (PIPE) using the primers indicated below (ΔG3526A/C_For and ΔG3526C Nat for I-PCR and p-pet1 and pet3 for V-PCR of the pET-21b vector (Novagen)). The expression vector was transformed in DH5α-T1 chemically competent cells for propagation (Invitrogen). BL21 (DE3) chemically competent cells were used for expression.

Figure 10:
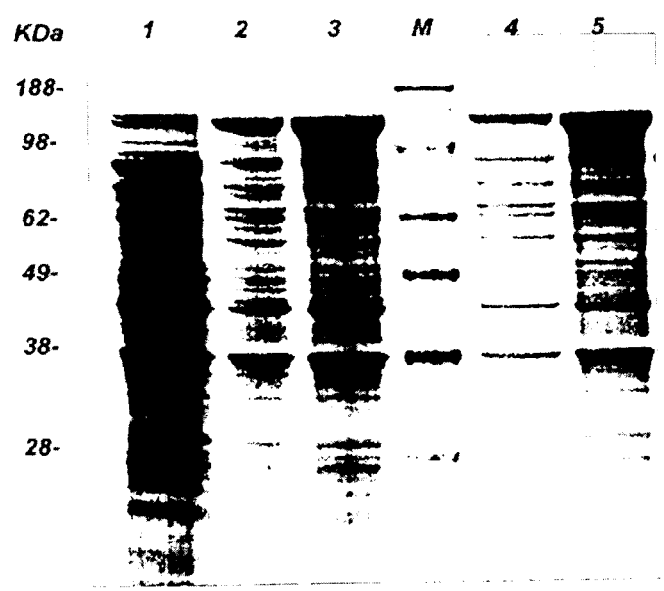
FIG. 10 shows an SDS-PAGE (4-12% gradient, Bis-Tris) of orf3526C expression. The lanes are labelled across the top as follows: (1) Total cell lysate—no IPTG, 6 hours at 25° C.; (2) Total cell lysate—1 mM IPTG, 3 hours at 25° C.; (3) Total cell lysate—1 mM IPTG, 6 hours at 25° C.; (M) Markers (sizes are indicated in kDa along the left side of the gel); (4) soluble fraction after sonication—1 mM IPTG, 3 hours at 25° C.; and (5) soluble fraction after sonication—1 mM IPTG, 6 hours at 25° C.

The his-tagged version of ΔG3526C was expressed (See, e.g., FIG. 10) without the signal sequence and purified by affinity chromatography based upon the his-tag.

Primers Used for Amplification of the Non-his-Tagged Fragment (SEQ ID NOs: 104 & 105)

```
ΔG3526C  ΔG3526A/C_For  gaaggagatatacatatgGATACGCCGTCTGTAGATTCTGG
(NdeI)

ΔG3526C_NatRev  gtggtggtgctcgagTTACCAAATCAGCCAGTCGTTCAGC
(XhoI)
```

Primers Used for Amplification of the his-Tagged Fragment (I-PCR): SEQ ID NOs: 106 & 107

```
ΔG3526C  ΔG3526A/C_For  gaaggagatatacatatgGATACGCCGTCTGTAGATTCTGG
(NdeI)

ΔG3526C_Rev  gtggtggtgctcgagCCAAATCAGCCAGTCGTTCAGC
(XhoI)
```

Primers Used for Amplification of the Expression Vector (V-PCR): SEQ ID NOs: 108 & 109

```
pET-21b   p-pet1 catatgatatctccttcttaaagTTAAACAAAATT
                 ATTTCTAG p-pet3 CTCGAGCACCACCACCAC
```

Immunogenicity-ΔG3526C

To confirm that the additional fragment had substantially the same immunogenicity as the full length AcfD (orf3526), the fragment was purified. The purified fragment was then tested as follows. Two groups of 8 CD1 mice (4 weeks old) were immunized s.c. with three doses of antigen ΔG3526C (either 2 µg or 20 µg), formulated in Alum at days 0, 31 and 35. 14 days after last immunization (11 weeks old mice) mice were infected i.p. with pathogenic E. coli strain IHE3034. Blood was collected from the tail after 24 hours to evaluate bacteremia. Mortality was monitored for 4 days after the infection. Protection was calculated as % survival at day 4 and statistical analysis was carried out by Fisher's exact test. Results of the challenge are shown in Table 4 below.

TABLE 4

| | Sepsis animal model | | |
|---|---|---|---|
| Candidate: ΔG3526C | Survival with vaccination (%) | Survival without vaccination (%) | P value |
| 2 µg/alum | 13/16 (81) | 0/7 (0) | 0.0005 |
| 20 µg/alum | 15/16 (93) | 0/7 (0) | 0.0001 |

Cross-Strain Immunogenicity-ΔG3526C

To further confirm the utility of the additional fragment in providing protection against multiple strains, the purified fragment was further tested as follows. CD1 mice (4 weeks old) were immunized s.c. with three doses of antigen ΔG3526C (either 10 µg or 20 µg), formulated in Alum at days 0, 31 and 35. 14 days after last immunization (11 weeks old mice) mice were infected i.p. with the pathogenic E. coli strain as indicated on Table 5. Blood was collected from the tail after 24 hours to evaluate bacteremia. Mortality was monitored for 4 days after the infection. Protection was calculated as % survival at day 4 and statistical analysis was carried out by Fisher's exact test. Results of the challenge are shown in Table 5 below.

TABLE 5

| Challenge Strain | Candidate ΔG3526C with Alum | |
|---|---|---|
| (infectious dose) | 20 µg/alum | 10 µg/alum |
| IHE3034 (1 × 10⁷ CFU) | Survival: 15/16 (93%) PE: 93% | Survival: 6/8 (75%) PE: 75% |
| 536 (1 × 10⁷ CFU i.v.) | Survival: 5/8 (62.5%) PE: 50% | Survival: 6/8 (75%) PE: 66% |
| 9855/93 (1 × 10⁷ CFU) | | Survival: 23/47 (49%) PE: 39% |
| B616 (2.5 × 10⁷ CFU) | Survival: 6/8 (75%) PE: 66% | Survival: 22/24 (91%) PE: 87% |
| UR41/S (2.5 × 10⁷ CFU) | | Survival: 4/8 (50%) PE: 50% |
| UR40/R (5 × 10⁶ CFU) | Survival: 5/8 (62.5%) PE: 62.5% | % |
| IN22/R (1 × 10⁷ CFU) | Survival: 7/8 (87.5%) PE: 80% | |

It will be understood that the invention has been described by way of example only and modifications may be made whilst remaining within the scope and spirit of the invention.

REFERENCES

The Contents of which are Hereby Incorporated in Full

[1] Kaper et al. (2004) *Nat Rev Microbiol.* 2(2):123-40.
[2] Anjum et al. (2007) *Appl Environ Microbiol* 73:5692-7.
[3] Russo & Johnson (2000) *J Infect Dis* 181:1753-1754.
[4] Smith et al. (2007) *Foodborne Pathogens And Disease* 4:134-63.
[5] WO2006/089264.
[6] WO2006/091517.
[7] Needleman & Wunsch (1970) *J. Mol. Biol.* 48, 443-453.
[8] Rice et al. (2000) *Trends Genet* 16:276-277.
[9] Geysen et al. (1984) *PNAS USA* 81:3998-4002.
[10] Carter (1994) *Methods Mol Biol* 36:207-23.
[11] Jameson, B A et al., 1988, *CABIOS* 4(1):181-186.
[12] Raddrizzani & Hammer (2000) *Brief Bioinform* 1(2):179-89.
[13] Bublil et al. (2007) *Proteins* 68(1):294-304.
[14] De Lalla et al. (1999) *J. Immunol.* 163:1725-29.
[15] Kwok et al. (2001) *Trends Immunol* 22:583-88.
[16] Brusic et al. (1998) *Bioinformatics* 14(2):121-30
[17] Meister et al. (1995) *Vaccine* 13(6):581-91.
[18] Roberts et al. (1996) *AIDS Res Hum Retroviruses* 12(7):593-610.
[19] Maksyutov & Zagrebelnaya (1993) *Comput Appl Biosci* 9(3):291-7.
[20] Feller & de la Cruz (1991) *Nature* 349(6311):720-1.
[21] Hopp (1993) *Peptide Research* 6:183-190.
[22] Welling et al. (1985) *FEBS Lett.* 188:215-218.
[23] Davenport et al. (1995) *Immunogenetics* 42:392-297.
[24] Tsurui & Takahashi (2007) *J Pharmacol Sci.* 105(4):299-316.
[25] Tong et al. (2007) *Brief Bioinform.* 8(2):96-108.
[26] Schirle et al. (2001) *J Immunol Methods.* 257(1-2):1-16.
[27] Chen et al. (2007) *Amino Acids* 33(3):423-8.
[28] U.S. Pat. No. 5,707,829
[29] *Current Protocols in Molecular Biology* (F. M. Ausubel et al. eds., 1987) Supplement 30.
[30] *Vaccine Design: The Subunit and Adjuvant Approach* (eds. Powell & Newman) Plenum Press 1995 (ISBN 0-306-44867-X).
[31] *Vaccine Adjuvants: Preparation Methods and Research Protocols* (Volume 42 of *Methods in Molecular Medicine* series). ISBN: 1-59259-083-7. Ed. O'Hagan.
[32] U.S. Pat. No. 6,355,271.
[33] WO00/23105.
[34] WO90/14837.
[35] WO90/14837.
[36] Podda & Del Giudice (2003) *Expert Rev Vaccines* 2:197-203.
[37] Podda (2001) *Vaccine* 19: 2673-2680.
[38] *Vaccine Design: The Subunit and Adjuvant Approach* (eds. Powell & Newman) Plenum Press 1995 (ISBN 0-306-44867-X).

[39] *Vaccine Adjuvants: Preparation Methods and Research Protocols* (Volume 42 of *Methods in Molecular Medicine* series). ISBN: 1-59259-083-7. Ed. O'Hagan.
[40] Allison & Byars (1992) *Res Immunol* 143:519-25.
[41] Hariharan et al. (1995) *Cancer Res* 55:3486-9.
[42] US-2007/014805.
[43] Suli et al. (2004) *Vaccine* 22(25-26):3464-9.
[44] WO95/11700.
[45] U.S. Pat. No. 6,080,725.
[46] WO2005/097181.
[47] WO2006/113373.
[48] Han et al. (2005) Impact of Vitamin E on Immune Function and Infectious Diseases in the Aged at Nutrition, Immune functions and Health EuroConference, Paris, 9-10 Jun. 2005.
[49] U.S. Pat. No. 6,630,161.
[50] U.S. Pat. No. 5,057,540.
[51] WO96/33739.
[52] EP-A-0109942.
[53] WO96/11711.
[54] WO00/07621.
[55] Barr et al. (1998) *Advanced Drug Delivery Reviews* 32:247-271.
[56] Sjolanderet et al. (1998) *Advanced Drug Delivery Reviews* 32:321-338.
[57] Niikura et al. (2002) *Virology* 293:273-280.
[58] Lenz et al. (2001) *J Immunol* 166:5346-5355.
[59] Pinto et al. (2003) *J Infect Dis* 188:327-338.
[60] Gerber et al. (2001) *J Virol* 75:4752-4760.
[61] WO03/024480.
[62] WO03/024481.
[63] Gluck et al. (2002) *Vaccine* 20:B10-B16.
[64] EP-A-0689454.
[65] Johnson et al. (1999) *Bioorg Med Chem Lett* 9:2273-2278.
[66] Evans et al. (2003) *Expert Rev Vaccines* 2:219-229.
[67] Meraldi et al. (2003) *Vaccine* 21:2485-2491.
[68] Pajak et al. (2003) *Vaccine* 21:836-842.
[69] Kandimalla et al. (2003) *Nucleic Acids Research* 31:2393-2400.
[70] WO02/26757.
[71] WO99/62923.
[72] Krieg (2003) *Nature Medicine* 9:831-835.
[73] McCluskie et al. (2002) *FEMS Immunology and Medical Microbiology* 32:179-185.
[74] WO98/40100.
[75] U.S. Pat. No. 6,207,646.
[76] U.S. Pat. No. 6,239,116.
[77] U.S. Pat. No. 6,429,199.
[78] Kandimalla et al. (2003) *Biochemical Society Transactions* 31 (part 3):654-658.
[79] Blackwell et al. (2003) *J Immunol* 170:4061-4068.
[80] Krieg (2002) *Trends Immunol* 23:64-65.
[81] WO01/95935.
[82] Kandimalla et al. (2003) *BBRC* 306:948-953.
[83] Bhagat et al. (2003) *BBRC* 300:853-861.
[84] WO03/035836.
[85] WO01/22972.
[86] Schellack et al. (2006) *Vaccine* 24:5461-72.
[87] WO95/17211.
[88] WO98/42375.
[89] Beignon et al. (2002) *Infect Immun* 70:3012-3019.
[90] Pizza et al. (2001) *Vaccine* 19:2534-2541.
[91] Pizza et al. (2000) *Int J Med Microbiol* 290:455-461.
[92] Scharton-Kersten et al. (2000) *Infect Immun* 68:5306-5313.
[93] Ryan et al. (1999) *Infect Immun* 67:6270-6280.
[94] Partidos et al. (1999) *Immunol Lett* 67:209-216.
[95] Peppoloni et al. (2003) *Expert Rev Vaccines* 2:285-293.
[96] Pine et al. (2002) *J Control Release* 85:263-270.
[97] Tebbey et al. (2000) *Vaccine* 18:2723-34.
[98] Domenighini et al. (1995) *Mol Microbiol* 15:1165-1167.
[99] WO99/40936.
[100] WO99/44636.
[101] Singh et al] (2001) *J Cont Release* 70:267-276.
[102] WO99/27960.
[103] U.S. Pat. No. 6,090,406.
[104] U.S. Pat. No. 5,916,588.
[105] EP-A-0626169.
[106] WO99/52549.
[107] WO01/21207.
[108] WO01/21152.
[109] Andrianov et al. (1998) *Biomaterials* 19:109-115.
[110] Payne et al. (1998) *Adv Drug Delivery Review* 31:185-196.
[111] U.S. Pat. No. 4,680,338.
[112] U.S. Pat. No. 4,988,815.
[113] WO92/15582.
[114] Stanley (2002) *Clin Exp Dermatol* 27:571-577.
[115] Wu et al. (2004) *Antiviral Res.* 64(2):79-83.
[116] Vasilakos et al. (2000) *Cell Immunol.* 204(1):64-74.
[117] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293.
[118] Jones (2003) *Curr Opin Investig Drugs* 4:214-218.
[119] WO03/011223.
[120] Johnson et al. (1999) *Bioorg Med Chem Lett* 9:2273-2278.
[121] Evans et al. (2003) *Expert Rev Vaccines* 2:219-229.
[122] WO2004/060308.
[123] WO2004/064759.
[124] U.S. Pat. No. 6,924,271.
[125] US2005/0070556.
[126] U.S. Pat. No. 5,658,731.
[127] U.S. Pat. No. 5,011,828.
[128] WO2004/87153.
[129] U.S. Pat. No. 6,605,617.
[130] WO02/18383.
[131] WO2004/018455.
[132] WO03/082272.
[133] Wong et al. (2003) *J Clin Pharmacol* 43(7):735-42.
[134] US2005/0215517.
[135] Dyakonova et al. (2004) Int Immunopharmacol 4(13):1615-23.
[136] FR-2859633.
[137] Signorelli & Hadden (2003) *Int Immunopharmacol* 3(8):1177-86.
[138] WO2004/064715.

[139] De Libero et al, *Nature Reviews Immunology,* 2005, 5: 485-496
[140] U.S. Pat. No. 5,936,076.
[141] Oki et al, *J. Clin. Investig.,* 113: 1631-1640
[142] US2005/0192248
[143] Yang et al, *Angew. Chem. Int. Ed.,* 2004, 43: 3818-3822
[144] WO2005/102049
[145] Goff et al, *J. Am. Chem., Soc.,* 2004, 126: 13602-13603
[146] WO03/105769
[147] Cooper (1995) *Pharm Biotechnol* 6:559-80.
[148] WO99/11241.
[149] WO94/00153.
[150] WO98/57659.
[151] European patent applications 0835318, 0735898 and 0761231.
[152] Durant et al. (2007) *Infect Immun* 75:1916-25.
[153] WO02/081653.
[154] Donnelly et al. (1997) *Annu Rev Immunol* 15:617-648.
[155] Strugnell et al. (1997) *Immunol Cell Biol* 75(4):364-369.
[156] Cui (2005) *Adv Genet.* 54:257-89.
[157] Robinson & Torres (1997) *Seminars in Immunol* 9:271-283.
[158] Brunham et al. (2000) *J Infect Dis* 181 Suppl 3:S538-43.
[159] Svanholm et al. (2000) *Scand J Immunol* 51(4):345-53.
[160] *DNA Vaccination—Genetic Vaccination* (1998) eds. Koprowski et al. (ISBN 3540633928).
[161] *Gene Vaccination: Theory and Practice* (1998) ed. Raz (ISBN 3540644288).
[162] Findeis et al., *Trends Biotechnol.* (1993) 11:202
[163] Chiou et al. (1994) *Gene Therapeutics: Methods And Applications Of Direct Gene Transfer.* ed. Wolff
[164] Wu et al., *J. Biol. Chem.* (1988) 263:621
[165] Wu et al., *J. Biol. Chem.* (1994) 269:542
[166] Zenke et al., *Proc. Natl. Acad. Sci.* (USA) (1990) 87:3655
[167] Wu et al., *J. Biol. Chem.* (1991) 266:338
[168] Jolly, *Cancer Gene Therapy* (1994) 1:51
[169] Kimura, *Human Gene Therapy* (1994) 5:845
[170] Connelly, *Human Gene Therapy* (1995) 1:185
[171] Kaplitt, *Nature Genetics* (1994) 6:148
[172] WO 90/07936.
[173] WO 94/03622.
[174] WO 93/25698.
[175] WO 93/25234.
[176] U.S. Pat. No. 5,219,740.
[177] WO 93/11230.
[178] WO 93/10218.
[179] U.S. Pat. No. 4,777,127.
[180] GB Patent No. 2,200,651.
[181] EP-A-0345242.
[182] WO 91/02805.
[183] WO 94/12649.
[184] WO 93/03769.
[185] WO 93/19191.
[186] WO 94/28938.
[187] WO 95/11984.
[188] WO 95/00655.
[189] Curiel, *Hum. Gene Ther.* (1992) 3:147
[190] Wu, *J. Biol. Chem.* (1989) 264:16985
[191] U.S. Pat. No. 5,814,482.
[192] WO 95/07994.
[193] WO 96/17072.
[194] WO 95/30763.
[195] WO 97/42338.
[196] WO 90/11092.
[197] U.S. Pat. No. 5,580,859
[198] U.S. Pat. No. 5,422,120
[199] WO 95/13796.
[200] WO 94/23697.
[201] WO 91/14445.
[202] EP-0524968.
[203] Philip, *Mol. Cell. Biol.* (1994) 14:2411
[204] Woffendin, *Proc. Natl. Acad. Sci.* (1994) 91:11581
[205] U.S. Pat. No. 5,206,152.
[206] WO 92/11033.
[207] U.S. Pat. No. 5,149,655.
[208] Gennaro (2000) *Remington: The Science and Practice of Pharmacy.* 20th edition, ISBN: 0683306472.
[209] *Methods In Enzymology* (S. Colowick and N. Kaplan, eds., Academic Press, Inc.)
[210] *Handbook of Experimental Immunology,* Vols. I-IV (D. M. Weir and C. C. Blackwell, eds, 1986, Blackwell Scientific Publications)
[211] Sambrook et al. (2001) *Molecular Cloning: A Laboratory Manual,* 3rd edition (Cold Spring Harbor Laboratory Press).
[212] Handbook of Surface and Colloidal Chemistry (Birdi, K. S. ed., CRC Press, 1997)
[213] Ausubel et al. (eds) (2002) *Short protocols in molecular biology,* 5th edition (Current Protocols).
[214] *Molecular Biology Techniques: An Intensive Laboratory Course,* (Ream et al., eds., 1998, Academic Press)
[215] PCR (*Introduction to Biotechniques Series*), 2nd ed. (Newton & Graham eds., 1997, Springer Verlag)
[216] *Current Protocols in Molecular Biology* (F. M. Ausubel et al., eds., 1987) Supplement 30
[217] Smith & Waterman (1981) *Adv. Appl. Math.* 2: 482-489.

SEQUENCE LISTING (126 sequences)

SEQ ID NO: 1 - protein, 1520 aa, Escherichia coli
MNKKFKYKKSLLAAILSATLLAGCDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 2 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 3 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHEAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 4 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 5 - protein, 1522 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 6 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 7 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 8 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 9 - protein, 1520 aa, Escherichia coli
MNKKFKYKKSLLAAILSATLLAGCDGGGSGSSSDTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 10 - protein, 1519 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 11 - protein, 1523 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 12 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 13 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 14 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 15 - protein, 1524 aa, Escherichia coli
MNKKFKYKKSLLAAILSATLLAGCDGGGSGPSSDTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 16 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 17 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 18 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 19 - protein, 1520 aa, Escherichia coli; identical to SEQ ID NO: 1

SEQ ID NO: 20 - protein, 738 aa, Escherichia coli
CDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNN

SEQ ID NO: 21 - protein, 739 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 22 - protein, 739 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 23 - protein, 738 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 24 - protein, 740 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 25 - protein, 740 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNN

SEQ ID NO: 26 - protein, 740 aa, Escherichia coli; identical to SEQ ID NO: 24

SEQ ID NO: 27 - protein, 740 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 28 - protein, 740 aa, Escherichia coli
CDGGGSGSSSDTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNN

SEQ ID NO: 29 - protein, 738 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNN

SEQ ID NO: 30 - protein, 739 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNN

SEQ ID NO: 31 - protein, 738 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNN

SEQ ID NO: 32 - protein, 738 aa, Escherichia coli; identical to SEQ ID NO: 23

SEQ ID NO: 33 - protein, 738 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNN

SEQ ID NO: 34 - protein, 739 aa, Escherichia coli
CDGGGSGPSSDTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNT

SEQ ID NO: 35 - protein, 740 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNN

SEQ ID NO: 36 - protein, 736 aa, Escherichia coli
CDGGGSGSSSDTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNN

SEQ ID NO: 37 - protein, 738 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNN

SEQ ID NO: 38 - protein, 738 aa, Escherichia coli; identical to SEQ ID NO: 20

SEQ ID NO: 39 - protein, 759 aa, Escherichia coli
DPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 40 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 41 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHEAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 42 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 43 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 44 - protein, 757 aa, Escherichia coli
DPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 45 - protein, 758 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 46 - protein, 758 aa, Escherichia coli
DPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 47 - protein, 757 aa, Escherichia coli
DPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 48 - protein, 758 aa, Escherichia coli
DPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 49 - protein, 761 aa, Escherichia coli
DPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 50 - protein, 757 aa, Escherichia coli
DPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 51 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 52 - protein, 757 aa, Escherichia coli
DPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 53 - protein, 762 aa, Escherichia coli
DPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 54 - protein, 758 aa, Escherichia coli
DPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 55 - protein, 759 aa, Escherichia coli
DPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 56 - protein, 759 aa, Escherichia coli
DPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 57 - protein, 759 aa, Escherichia coli; identical to SEQ ID NO: 39

SEQ ID NO: 58 - protein, 1497 aa, Escherichia coli
CDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHAVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 59 - protein, 1498 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 60 - protein, 1498 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHAAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 61 - protein, 1497 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHAVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 62 - protein, 1499 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 63 - protein, 1497 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 64 - protein, 1498 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 65 - protein, 1498 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 66 - protein, 1497 aa, Escherichia coli
CDGGGSGSSSDTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHAVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 67 - protein, 1496 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 68 - protein, 1500 aa, Escherichia coli
CDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHAVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 69 - protein, 1495 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 70 - protein, 1497 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHAVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 71 - protein, 1495 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 72 - protein, 1501 aa, Escherichia coli
CDGGGSGPSSDTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHAVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 73 - protein, 1498 aa, Escherichia coli
CDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 74 - protein, 1495 aa, Escherichia coli
CDGGGSGSSSDTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 75 - protein, 1497 aa, Escherichia coli
CDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHAVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 76 - protein, 1497 aa, Escherichia coli; identical to SEQ ID NO: 58

SEQ ID NO: 77 - protein, 1270 aa, Escherichia coli
DTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIW

SEQ ID NO: 78 - protein, 1270 aa, Escherichia coli
TPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIW

SEQ ID NO: 79 - protein, 1271 aa, Escherichia coli
DTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIW

SEQ ID NO: 80 - protein, 1269 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIW

SEQ ID NO: 81 - protein, 1271 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIW

SEQ ID NO: 82 - protein, 1270 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIW

SEQ ID NO: 83 - protein, 1271 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIW

SEQ ID NO: 84 - protein, 1270 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIW

SEQ ID NO: 85 - protein, 1270 aa, Escherichia coli
DTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIW

SEQ ID NO: 86 - protein, 1268 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIW

SEQ ID NO: 87 - protein, 1272 aa, Escherichia coli
DTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIW

SEQ ID NO: 88 - protein, 1268 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIW

SEQ ID NO: 89 - protein, 1269 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIW

SEQ ID NO: 90 - protein, 1268 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIW

SEQ ID NO: 91 - protein, 1274 aa, Escherichia coli
DTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIW

SEQ ID NO: 92 - protein, 1270 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIW

SEQ ID NO: 93 - protein, 1268 aa, Escherichia coli
DTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIW

SEQ ID NO: 94 - protein, 1270 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIW

SEQ ID NO: 95 - protein, 1270 aa, Escherichia coli; identical to SEQ ID NO: 77

SEQ ID NO: 96 - protein, 11 aa, Escherichia coli
HEVGHNYGLGH

SEQ ID NO: 97 - protein, 11 aa, Escherichia coli
HEVGHNAAETP

SEQ ID NO: 98 - DNA, 31 bp, Escherichia coli
ggaattccatatgtgtgatggtggtggttca

SEQ ID NO: 99 - DNA, 27 bp, Escherichia coli
ccgctcgaggttgttcaccaccgattt

SEQ ID NO: 100 - DNA, 30 bp, Escherichia coli
ggaattccatatggatccgcaagggtatcc

SEQ ID NO: 101 - DNA, 27 bp, Escherichia coli
ccgctcgagctcggcagacatcttatg

SEQ ID NO: 102 - DNA, 33 bp, Escherichia coli
acgactggctgatttggcacgcagtcggtcata

SEQ ID NO: 103 - DNA, 30 bp, Escherichia coli
gtgccaaatcagccagtcgttcagcggcgt

SEQ ID NO: 104 - DNA, 41 bp, Escherichia coli
gaaggagatatacatatggatacgccgtctgtagattctgg

SEQ ID NO: 105 - DNA, 40 bp, Escherichia coli
gtggtggtgctcgagttaccaaatcagccagtcgttcagc

SEQ ID NO: 106 - DNA, 41 bp, Escherichia coli; identical to SEQ ID NO: 104

SEQ ID NO: 107 - DNA, 37 bp, Escherichia coli
gtggtggtgctcgagccaaatcagccagtcgttcagc

SEQ ID NO: 108 - DNA, 43 bp, Escherichia coli
catatgatatctccttcttaaagttaaacaaaattatttctag

SEQ ID NO: 109 - DNA, 18 bp, Escherichia coli
ctcgagcaccaccaccac

SEQ ID NO: 110 - protein, 26 aa, Escherichia coli
ICICICICICICICICICICICICIC

SEQ ID NO: 111 - protein, 11 aa, Escherichia coli
KLKLLLLLKLK

SEQ ID NO: 112 - protein, 3 aa, Artificial Sequence
  Synthetic Construct
  VARIANT 2: Xaa = Any Amino Acid
HXH

SEQ ID NO: 113 - protein, 4 aa, Artificial Sequence
  Synthetic Construct
  VARIANT 2, 3: Xaa = Any Amino Acid
HXXE

SEQ ID NO: 114 - protein, 5 aa, Artificial Sequence
  Synthetic Construct
  VARIANT 3, 4: Xaa = Any Amino Acid
HEXXH

SEQ ID NO: 115 - protein, 5 aa, Artificial Sequence
  Synthetic Construct
  VARIANT 2, 3: Xaa = Any Amino Acid
HXXEH

SEQ ID NO: 116 - protein, 9 aa, Artificial Sequence
  Synthetic Construct
  VARIANT 2, 3, 6, 7: Xaa = Any Amino Acid
GXXNEXXSD

SEQ ID NO: 117 - protein, 8 aa, Artificial Sequence
  Synthetic Construct
  VARIANT 3, 6: Xaa = Any Amino Acid
ENXADXGG

SEQ ID NO: 118 - protein, 8 aa, Artificial Sequence
  Synthetic Construct
  VARIANT 3: Xaa = Any Amino Acid
EAXGDVLA

SEQ ID NO: 119 - protein, 7 aa, Artificial Sequence
  Synthetic Construct
  VARIANT 7: Xaa = Any Amino Acid
LWLNEGX

SEQ ID NO: 120 - protein, 4 aa, Artificial Sequence
  Synthetic Construct
  VARIANT 1, 4: Xaa = Any Amino Acid
XEEX

SEQ ID NO: 121 - protein, 11 aa, Artificial Sequence
  Synthetic Construct
  VARIANT 1, 4, 7, 8, 9, 11: Xaa = Any Amino Acid
XVEXPSXXXEX

SEQ ID NO: 122 - protein, 6 aa, Artificial Sequence
  Synthetic Construct
  VARIANT 1, 2, 4, 5: Xaa = Any Amino Acid
XXGXXH

SEQ ID NO: 123 - protein, 5 aa, Artificial Sequence
  Synthetic Construct
  VARIANT 2: Xaa = Any Amino Acid
SXMSY

SEQ ID NO: 124 - protein, 5 aa, Artificial Sequence
  Synthetic Construct
  VARIANT 2: Xaa = Any Amino Acid
SXMHY

SEQ ID NO: 125 - protein, 5 aa, Artificial Sequence
  Synthetic Construct
  VARIANT 4: Xaa = Any Amino Acid
CIMXP

SEQ ID NO: 126 - protein, 5 aa, Artificial Sequence
  Synthetic Construct
  VARIANT 2: Xaa = Any Amino Acid
AXMYP

The invention claimed is:

1. An immunogenic polypeptide comprising a polypeptide having at least 80% sequence identity to the amino acid sequence of SEQ ID NO:1 and comprising a point mutation at amino acid number 1305 based upon alignment with SEQ ID NO:1 wherein the point mutation decreases the toxicity of the immunogenic polypeptide as compared to a protein selected from the group consisting of SEQ ID NOs: 1-19 and wherein the immunogenic polypeptide raises at least 70% of the immune response of the immune response in a subject as a polypeptide with the amino acid sequence of SEQ ID NO:1.

2. The immunogenic polypeptide of claim 1, wherein the polypeptide contains a deletion relative to SEQ ID NO:1 which increases solubility of the immunogenic polypeptide as compared to a protein selected from the group consisting of SEQ ID NOs:1-19.

3. The immunogenic polypeptide of claim 2, wherein the deletion is removal of substantially all of the N-terminal amino acids up to the gly-ser region, removal of all or a part of the N-terminal proline-rich repeat, or both.

4. The immunogenic polypeptide of claim 2, wherein the deletion is removal of at least the first 20 N-terminal amino acids as compared to the *E. coli* AcfD (orf3526) protein, at least the first 20 N-terminal amino acids as compared to the *E. coli* AcfD (orf3526) protein, at least the first 30 N-terminal amino acids as compared to the *E. coli* AcfD (orf3526) protein, at least the first 38 N-terminal amino acids as compared to the *E. coli* AcfD (orf3526) protein, at least the first 40 N-terminal amino acids as compared to the *E. coli* AcfD (orf3526) protein, at least the first 50 N-terminal amino acids as compared to the *E. coli* AcfD (orf3526) protein, at least the first 60 N-terminal amino acids as compared to the *E. coli* AcfD (orf3526) protein, at least the first 70 N-terminal amino acids as compared to the *E. coli* AcfD (orf3526) protein, at least the first 80 N-terminal amino acids as compared to the *E. coli* AcfD (orf3526) protein, at least the first 90 N-terminal amino acids as compared to the *E. coli* AcfD (orf3526) protein, or at least the first 94 N-terminal amino acids as compared to the *E. coli* AcfD (orf3526) protein.

5. The immunogenic polypeptide of claim 1 wherein the immunogenic polypeptide is isolated, purified, or recombinant.

6. A polynucleotide encoding the immunogenic polypeptide of claim 1.

7. An *E. coli* cell, containing a plasmid that encodes the immunogenic polypeptide of claim 1.

8. A vaccine component comprising the immunogenic polypeptide of claim 7.

9. A vaccine comprising the vaccine component of claim 8.

10. The vaccine of claim 9 further comprising an adjuvant.

11. The vaccine of claim 9 further comprising an additional vaccine component selected from: a *Neisseria meningitidis* antigen, a *Streptococcus pneumoniae* antigen, a *Streptococcus pyogenes* antigen, a *Moraxella catarrhalis* antigen, a *Bordetella pertussis* antigen, a *Staphylococcus aureus* antigen, a *Staphylococcus epidermis* antigen, a *Clostridium tetani* antigen, a *Cornynebacterium diphtheriae* antigen, a *Haemophilus influenzae* type B (Hib) antigen, a *Pseudomonas aeruginosa* antigen, a *Legionella pneumophila* antigen, a *Streptococcus agalactiae* antigen, a *Neiserria gonorrhoeae* antigen, a *Chlamydia trachomatis* antigen, a *Treponema pallidum* antigen, a *Haemophilus ducreyi* antigen, a *Enterococcus faecalis* antigen, a *Enterococcus faecium* antigen, a *Helicobacter pylori* antigen, a *Staphylococcus saprophyticus* antigen, a *Yersinia enterocolitica* antigen, an additional *E. coli* antigen, a *Bacillus anthracis* antigen, a *Yersinia pestis* antigen, a *Mycobacterium tuberculosis* antigen, a *Rickettsia* antigen, a *Listeria monocytogenes* antigen, a *Chlamydia pneumoniae* antigen, a *Vibrio cholerae* antigen, a *Salmonella typhi* antigen, a *Borrelia burgdorferi* antigen, a *Porphyromonas gingivalis* antigen, and a *Klebsiella* antigen.

12. The immunogenic polypeptide of claim 1 wherein the polypeptide contains a C-terminal deletion as compared to the amino acid sequence of SEQ ID NO:1, wherein the immunogenic polypeptide does not comprise at least the last 100 C-terminal amino acids or at least the last 200 C-terminal amino acids.

13. The immunogenic polypeptide of claim 1 wherein the polypeptide contains a N-terminal deletion as compared to the amino acid sequence of SEQ ID NO:1 wherein the immunogenic polypeptide does not comprise at least the first 100 N-terminal amino acids, at least the first 200 N-terminal amino acids or at least the first 300 N-terminal amino acids.

14. The immunogenic polypeptide of claim 1 selected from the group consisting of SEQ ID NOs: 58-77.

15. The immunogenic polypeptide of claim 2 wherein the deletion is removal of at least the first 20 N-terminal amino acids, at least the first 30 N-terminal amino acids, at least the first 38 N-terminal amino acids, at least the first 40 N-terminal amino acids, at least the first 50 N-terminal amino acids, at least the first 60 N-terminal amino acids, at least the first 70 N-terminal amino acids, at least the first 80 N-terminal amino acids, at least the first 90 N-terminal amino acids, or at least the first 94 N-terminal amino acids as compared to the amino acid sequence of SEQ ID NO:1.

* * * * *